United States Patent
Brown et al.

(10) Patent No.: US 8,927,515 B2
(45) Date of Patent: Jan. 6, 2015

(54) METHODS AND COMPOSITIONS FOR THE SPECIFIC INHIBITION OF ANDROGEN RECEPTOR BY DOUBLE-STRANDED RNA

(71) Applicant: Dicerna Pharmaceuticals, Inc., Watertown, MA (US)

(72) Inventors: Bob D. Brown, Millington, NJ (US); Henryk T. Dudek, Wellesley, MA (US)

(73) Assignee: Dicerna Pharmaceuticals, Inc., Watertown, MA (US)

( * ) Notice: Subject to any disclaimer, the term of this patent is extended or adjusted under 35 U.S.C. 154(b) by 87 days.

(21) Appl. No.: 13/723,623

(22) Filed: Dec. 21, 2012

(65) Prior Publication Data

US 2013/0131149 A1 May 23, 2013

Related U.S. Application Data

(63) Continuation of application No. PCT/US2011/042810, filed on Jul. 1, 2011.

(60) Provisional application No. 61/361,759, filed on Jul. 6, 2010.

(51) Int. Cl.
| | | |
|---|---|---|
| *A61K 31/70* | (2006.01) | |
| *C07H 21/02* | (2006.01) | |
| *C07H 21/04* | (2006.01) | |
| *C12N 15/113* | (2010.01) | |
| *C12Q 1/68* | (2006.01) | |
| *A61K 31/713* | (2006.01) | |
| *A61K 31/7105* | (2006.01) | |

(52) U.S. Cl.
CPC ........... *C12N 15/1138* (2013.01); *A61K 31/713* (2013.01); *A61K 31/7105* (2013.01); *C12N 2310/14* (2013.01)
USPC ....... 514/44 A; 536/23.1; 536/24.1; 536/24.5; 435/375; 435/377

(58) Field of Classification Search
None
See application file for complete search history.

(56) References Cited

U.S. PATENT DOCUMENTS

| | | | |
|---|---|---|---|
| 8,090,542 B2 * | 1/2012 | Khvorova et al. | 702/20 |
| 2005/0164970 A1 | 7/2005 | Li | 514/44 |
| 2005/0170371 A1 | 8/2005 | McSwiggen et al. | 435/6 |
| 2006/0257851 A1 | 11/2006 | Bentwich | 435/5 |
| 2009/0043083 A1 | 2/2009 | Rossi et al. | 536/23.1 |

OTHER PUBLICATIONS

International Searching Authority, International Search Report—International Application No. PCT/US2011/042810, dated Dec. 30, 2011, 8 pages.

* cited by examiner

*Primary Examiner* — Sean McGarry
(74) *Attorney, Agent, or Firm* — Edwards Wildman Palmer LLP; Christopher R. Cowles

(57) ABSTRACT

This invention relates to compounds, compositions, and methods useful for reducing AR target RNA and protein levels via use of dsRNAs, e.g., Dicer substrate siRNA (DsiRNA) agents.

42 Claims, 45 Drawing Sheets

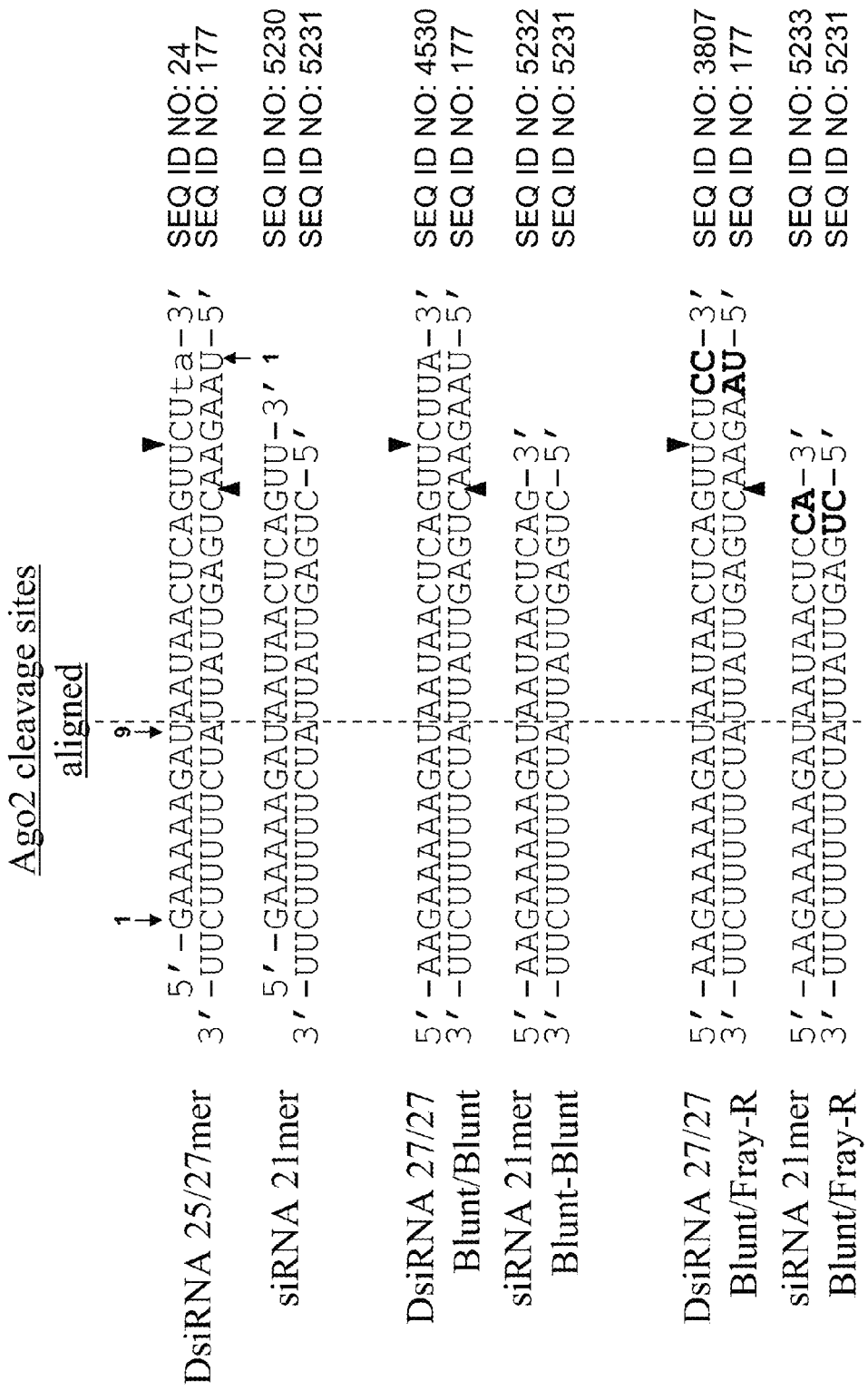

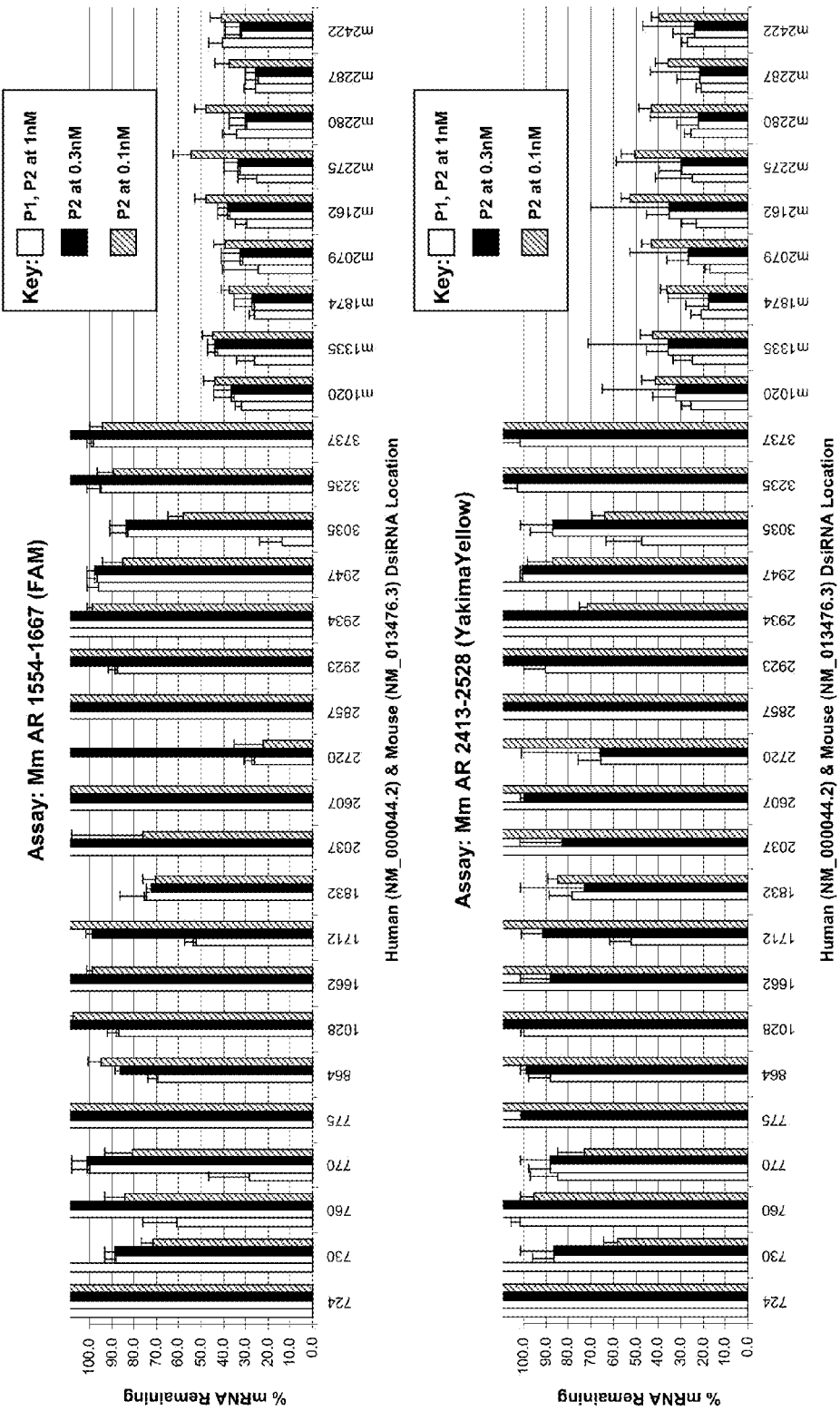

METHODS AND COMPOSITIONS FOR THE SPECIFIC INHIBITION OF ANDROGEN RECEPTOR BY DOUBLE-STRANDED RNA

CROSS-REFERENCE TO RELATED APPLICATIONS

The present application is a Continuation of PCT international application Ser. No. PCT/US2011/042810, filed Jul. 1, 2011, designating the United States, which claims priority to, and the benefit under 35 U.S.C. §119(e) of, U.S. provisional patent application No. 61/361,759, filed Jul. 6, 2010. The entire contents of the aforementioned patent applications are incorporated herein by this reference.

FIELD OF THE INVENTION

The present invention relates to compounds, compositions, and methods for the study, diagnosis, and treatment of traits, diseases and conditions that respond to the modulation of androgen receptor (AR) gene expression and/or activity.

BACKGROUND OF THE INVENTION

AR is a ligand-activated steroid hormone receptor which functions as a transcription factor in prostate cells to regulate myriad genes involved in cell division, apoptosis and angiogenesis (Compagno et al., *PLoS One*, 2: e1006). Prostate carcinomas are initially androgen-dependent and, therefore, responsive to therapies that reduce or eliminate AR activation. Specifically, a variety of approaches aimed at manipulating the effects of androgen have been shown unequivocally to be efficacious in the treatment of prostatic carcinoma. Historically, orchiectomy and the administration of estrogen were first demonstrated to have beneficial effects. However, prostate cancers often escape from such treatments and recur (Heinlein and Chang, *Endocr Rev* 25: 276-308).

Gonadotropin-releasing hormone agonists (GnRH agonists) and antiandrogens have been shown to be safe and effective in multiple settings and have become the standards of care for patients at high risk of recurrence after initial surgery or radiotherapy or who recur after these procedures (Scher and Sawyers. *Journal of Clinical Oncology*, 23: 8253-8261; Baltogiannis et al. *Experimental Oncology*, 26: 185-191; National Comprehensive Cancer Network (2008). Practice guidelines in oncology, 1.2008, 1-44; Bhandari et al. *Journal of Clinical Oncology*, 23: 8212-8218; Clinical Care Options & Postgraduate Institute for Medicine (2006). Recent and Future Directions of Hormonal Therapy in Prostate Cancer. 1-22; Evans et al. *BJU International*, 95: 743-479; Use of 5-aplha-reductase inhibitors for prostate cancer chemoprevention: American society of clinical oncology/American urological association 2008 clinical practice guideline summary, (2009, May) *Journal of Oncology Practice*, 5: 127-129; O'Connor and Fitzpatrick. *BJU International*, 95: 22-28; Koltz and Schellhammer Combined androgen blockade: worth a second look. 1-17). Many studies have evaluated the development of resistance in patients receiving endocrine manipulations, and it is clear that potential reasons for the resistance seen with endocrine manipulation therapies include: increased expression of the androgen receptor, increased sensitivity of the androgen receptor, and increased local production of androgens by cells not sensitive to existing inhibitors. Recently, antiandrogens have been shown to have activity in patients with resistance to standard methods of treating prostatic cancer, further validating the role of this receptor even in patients who appear to have "castration-resistant" prostatic cancer. It appears clear that even in patients whose tumors fail to respond to standard therapies, inhibition of the androgen receptor directly by dsRNA agents directed to this target should be active and, because of the increased androgen receptor expression that characterizes prostate cancers resistant to traditional therapies, may be more active in subjects harboring resistant cancers than earlier stages of disease.

Double-stranded RNA (dsRNA) agents possessing strand lengths of 25 to 35 nucleotides have been described as effective inhibitors of target gene expression in mammalian cells (Rossi et al., U.S. Patent Application Nos. 2005/0244858 and US 2005/0277610). dsRNA agents of such length are believed to be processed by the Dicer enzyme of the RNA interference (RNAi) pathway, leading such agents to be termed "Dicer substrate siRNA" ("DsiRNA") agents. Additional modified structures of DsiRNA agents were previously described (Rossi et al., U.S. Patent Application No. 2007/0265220).

BRIEF SUMMARY OF THE INVENTION

The present invention is directed to compositions that contain double stranded RNA ("dsRNA"), and methods for preparing them. The dsRNAs of the invention are capable of reducing the expression of a target AR gene in a cell, either in vitro or in a mammalian subject. More particularly, the invention is directed to Dicer substrate siRNAs ("DsiRNAs") with structures and modification patterns that act as effective and highly potent AR inhibitory agents, optionally possessing extended duration of inhibitory effect. A number of such DsiRNAs possess target-specific inhibitory potencies and efficacies that are significantly enhanced relative to 21 nucleotide siRNAs directed against the same target RNA, as such an effect has been recently documented for DsiRNAs directed against a KRAS target transcript (see U.S. Ser. No. 12/754,427).

In one aspect, the invention provides an isolated double stranded ribonucleic acid (dsRNA) comprising first and second nucleic acid strands, wherein the first strand is 15-35 nucleotides in length and the second strand is 19-35 nucleotides in length, wherein the second oligonucleotide strand is sufficiently complementary to a target AR cDNA sequence of Table 13 along at least 19 nucleotides of the second oligonucleotide strand length to reduce AR target gene expression when the double stranded nucleic acid is introduced into a mammalian cell. In certain embodiments, the isolated dsRNA possesses a duplex region of at least 25 base pairs. In one embodiment, the second strand of the isolated dsRNA includes a one to five nucleotide single stranded overhang of the first strand at the 3' terminus of the second strand. In another embodiment, the first strand is 25-35 nucleotides in length. In an additional embodiment, the second strand is 25-35 nucleotides in length. Optionally, the second oligonucleotide strand is complementary to a target AR cDNA sequence of GenBank Accession Nos. NM_000044.2 or NM_001011645.1 along at most 27 nucleotides of the second oligonucleotide strand length.

In one embodiment, starting from the first nucleotide (position 1) at the 3' terminus of the first oligonucleotide strand, position 1, 2 and/or 3 is substituted with a modified nucleotide. In certain embodiments, the modified nucleotide residue of the 3' terminus of the first strand is a deoxyribonucleotide, an acyclonucleotide or a fluorescent molecule. In a related embodiment, position 1 of the 3' terminus of the first oligonucleotide strand is a deoxyribonucleotide.

In an additional embodiment, the 3' terminus of the first strand and the 5' terminus of the second strand form a blunt end.

In another embodiment, the first strand is 25 nucleotides in length and the second strand is 27 nucleotides in length.

In one embodiment, the second strand includes a sequence of SEQ ID NOs: 164, 166, 174, 177, 179, 1975, 1984, 1986, 1987, 1992, 1994, 1998, 224, 2074, 1283, 2136, 246, 2204, 2220, 2227, 2230, 2235 and 2239.

In another embodiment, the first strand includes a sequence of SEQ ID NOs: 11, 13, 21, 24, 26, 1570, 1579, 1581, 1582, 1587, 1589, 1593, 71, 1669, 1220, 1731, 93, 1799, 1815, 1822, 1825, 1830 and 1834.

In an additional embodiment, the dsRNA includes a pair of first strand/second strand sequences as shown for a DsiRNA agent of Tables 2, 3, 5, 7, 9 and 11.

In one embodiment, each of the first and the second strands has a length which is at least 26 nucleotides.

In another embodiment, the nucleotides of the 3' overhang include a modified nucleotide. Optionally, the modified nucleotide of the 3' overhang is a 2'-O-methyl ribonucleotide. In a related embodiment, all nucleotides of the 3' overhang are modified nucleotides.

In an additional embodiment, one or both of the first and second oligonucleotide strands includes a 5' phosphate.

In another embodiment, the modified nucleotide residues of the dsRNA are 2'-O-methyl, 2'-methoxyethoxy, 2'-fluoro, 2'-allyl, 2'-O-[2-(methylamino)-2-oxoethyl], 4'-thio, 4'-CH2-O-2'-bridge, 4'-(CH2)2-O-2'-bridge, 2'-LNA, 2'-amino or 2'-O—(N-methlycarbamate).

In one embodiment, the 3' overhang of the dsRNA is 1-3 nucleotides in length. Optionally, the 3' overhang is 1-2 nucleotides in length. In a related embodiment, the 3' overhang is two nucleotides in length and the modified nucleotide of the 3' overhang is a 2'-O-methyl modified ribonucleotide.

In a further embodiment, the second oligonucleotide strand, starting from the nucleotide residue of the second strand that is complementary to the 5' terminal nucleotide residue of the first oligonucleotide strand, includes alternating modified and unmodified nucleotide residues. In another embodiment, the second oligonucleotide strand, starting from the nucleotide residue of the second strand that is complementary to the 5' terminal nucleotide residue of the first oligonucleotide strand, includes unmodified nucleotide residues at all positions from position 18 to the 5' terminus of the second oligonucleotide strand.

In another embodiment, each of the first and the second strands has a length which is at least 26 and at most 30 nucleotides.

In one embodiment, the dsRNA is cleaved endogenously in the cell by Dicer.

In an additional embodiment, the amount of the isolated double stranded nucleic acid sufficient to reduce expression of the target gene is 1 nanomolar or less, 200 picomolar or less, 100 picomolar or less, 50 picomolar or less, 20 picomolar or less, 10 picomolar or less, 5 picomolar or less, 2 picomolar or less or 1 picomolar or less in the environment of the cell.

In a further embodiment, the isolated dsRNA possesses greater potency than isolated 21mer siRNAs directed to the identical at least 19 nucleotides of the target AR cDNA in reducing target AR gene expression when assayed in vitro in a mammalian cell at an effective concentration in the environment of a cell of 1 nanomolar or less, 200 picomolar or less, 100 picomolar or less, 50 picomolar or less, 20 picomolar or less, 10 picomolar or less, 5 picomolar or less, 2 picomolar or less or 1 picomolar or less.

In another embodiment, the isolated dsRNA is sufficiently complementary to the target AR cDNA sequence to reduce AR target gene expression by at least 10%, at least 50%, at least 80-90%, at least 95%, at least 98%, or at least 99% when the double stranded nucleic acid is introduced into a mammalian cell.

In a further embodiment, the first and second strands are joined by a chemical linker. In a related embodiment, the 3' terminus of the first strand and the 5' terminus of the second strand are joined by a chemical linker.

In one embodiment, a nucleotide of the second or first strand is substituted with a modified nucleotide that directs the orientation of Dicer cleavage.

In another embodiment, the dsRNA has a modified nucleotide that is a deoxyribonucleotide, a dideoxyribonucleotide, an acyclonucleotide, a 3'-deoxyadenosine (cordycepin), a 3'-azido-3'-deoxythymidine (AZT), a 2',3'-dideoxyinosine (ddI), a 2',3'-dideoxy-3'-thiacytidine (3TC), a 2',3'-didehydro-2',3'-dideoxythymidine (d4T), a monophosphate nucleotide of 3'-azido-3'-deoxythymidine (AZT), a 2',3'-dideoxy-3'-thiacytidine (3TC) and a monophosphate nucleotide of 2',3'-didehydro-2',3'-dideoxythymidine (d4T), a 4-thiouracil, a 5-bromouracil, a 5-iodouracil, a 5-(3-aminoallyl)-uracil, a 2'-O-alkyl ribonucleotide, a 2'-O-methyl ribonucleotide, a 2'-amino ribonucleotide, a 2'-fluoro ribonucleotide, or a locked nucleic acid.

In an additional embodiment, the dsRNA has a phosphonate, a phosphorothioate or a phosphotriesterphosphate backbone modification.

In a further embodiment, the dsRNA contains a morpholino nucleic acid or oligonucleotide, or a peptide nucleic acid (PNA).

In one embodiment, the invention provides a method for reducing expression of a target AR gene in a mammalian cell having contacting a mammalian cell in vitro with an isolated dsRNA as described in an amount sufficient to reduce expression of a target AR gene in the cell.

In one embodiment, target AR gene expression is reduced by at least 10%, at least 50%, or at least 80-90%. In another embodiment, target AR mRNA levels are reduced at least 90% at least 8 days after the cell is contacted with the dsRNA. In a further embodiment, AR mRNA levels are reduced by at least 70% at least 10 days after the cell is contacted with the dsRNA.

In a further embodiment, the invention provides a method for reducing expression of a target AR gene in a mammal by administering an isolated dsRNA as described to a mammal in an amount sufficient to reduce expression of a target AR gene in the mammal.

In one embodiment, the isolated dsRNA is administered at a dosage of 1 microgram to 5 milligrams per kilogram of the mammal per day, 100 micrograms to 0.5 milligrams per kilogram, 0.001 to 0.25 milligrams per kilogram, 0.01 to 20 micrograms per kilogram, 0.01 to 10 micrograms per kilogram, 0.10 to 5 micrograms per kilogram, or 0.1 to 2.5 micrograms per kilogram.

In another embodiment, the isolated dsRNA possesses greater potency than isolated 21mer siRNAs directed to the identical at least 19 nucleotides of the target AR cDNA in reducing target AR gene expression when assayed in vitro in a mammalian cell at an effective concentration in the environment of a cell of 1 nanomolar or less.

In an additional embodiment, the administering step includes intravenous injection, intramuscular injection, intraperitoneal injection, infusion, subcutaneous injection, transdermal, aerosol, rectal, vaginal, topical, oral or inhaled delivery.

In a further embodiment, the invention provides a method for selectively inhibiting the growth of a cell by contacting a cell with an amount of an isolated dsRNA as described, in an amount sufficient to inhibit the growth of the cell.

In one embodiment, the cell is a tumor cell of a subject. Optionally, the cell is a tumor cell in vitro, e.g., a prostate cancer cell (e.g., 22Rv1 or VCaP) or adenocarcinoma cell (e.g., A549), or other cancer cell. In certain embodiments, the cell is a mammalian prostate cell. In a related embodiment, the cell is a human cell.

In an additional embodiment, the invention provides a formulation which includes an isolated dsRNA as described, where the dsRNA is present in an amount effective to reduce target AR RNA levels when the dsRNA is introduced into a mammalian cell in vitro by at least 10%, at least 50% or at least 80-90%, and where the dsRNA possesses greater potency than isolated 21mer siRNAs directed to the identical at least 19 nucleotides of the target AR cDNA in reducing target AR RNA levels when assayed in vitro in a mammalian cell at an effective concentration in the environment of a cell of 1 nanomolar or less.

In one embodiment, the effective amount is 1 nanomolar or less, 200 picomolar or less, 100 picomolar or less, 50 picomolar or less, 20 picomolar or less, 10 picomolar or less, 5 picomolar or less, 2 picomolar or less or 1 picomolar or less in the environment of the cell.

In another embodiment, the invention provides a formulation which includes an isolated dsRNA as described, where the dsRNA is present in an amount effective to reduce target RNA levels when the dsRNA is introduced into a cell of a mammalian subject by at least 10%, at least 50% or at least 80-90%, and where the dsRNA possesses greater potency than isolated 21mer siRNAs directed to the identical at least 19 nucleotides of the target AR cDNA in reducing target AR RNA levels when assayed in vitro in a mammalian cell at an effective concentration in the environment of a cell of 1 nanomolar or less.

In one embodiment, the effective amount is a dosage of 1 microgram to 5 milligrams per kilogram of the subject per day, 100 micrograms to 0.5 milligrams per kilogram, 0.001 to 0.25 milligrams per kilogram, 0.01 to 20 micrograms per kilogram, 0.01 to 10 micrograms per kilogram, 0.10 to 5 micrograms per kilogram, or 0.1 to 2.5 micrograms per kilogram.

In an additional embodiment, the invention provides a mammalian cell containing an isolated dsRNA as described.

Another embodiment of the invention provides a pharmaceutical composition which includes an isolated dsRNA as described and a pharmaceutically acceptable carrier. A further embodiment of the invention provides a kit having an isolated dsRNA as described and instructions for its use.

In an additional aspect, the invention provides a composition possessing AR inhibitory activity consisting essentially of an isolated double stranded ribonucleic acid (dsRNA) comprising first and second nucleic acid strands, wherein the first strand is 15-35 nucleotides in length and the second strand is 19-35 nucleotides in length, wherein the second oligonucleotide strand is sufficiently complementary to a target AR cDNA sequence of Table 13 along at least 19 nucleotides of the second oligonucleotide strand length to reduce AR target gene expression when the double stranded nucleic acid is introduced into a mammalian cell.

In another embodiment, the invention provides a method for treating or preventing an AR-associated disease or disorder in a subject by administering a dsRNA and/or dsRNA-containing composition of the invention and a pharmaceutically acceptable carrier to a subject in an amount sufficient to treat or prevent an AR-associated disease or disorder in the subject. In a related embodiment, the AR-associated disease or disorder is prostate cancer or adenocarcinoma.

In another aspect, the invention provides an isolated double stranded ribonucleic acid (dsRNA) comprising first and second nucleic acid strands, wherein the dsRNA comprises blunt ends, wherein each of the first and second oligonucleotide strands consists of the same number of nucleotide residues and is at most 35 nucleotides in length, wherein the second oligonucleotide strand is sufficiently complementary to a target AR cDNA sequence of Table 13 along at least 19 nucleotides of the second oligonucleotide strand length to reduce AR target gene expression when the double stranded nucleic acid is introduced into a mammalian cell.

In one embodiment, the dsRNA is capable of reducing target gene expression at a concentration of less than 1 nanomolar in the environment of a cell. In another embodiment, each of the first and the second strands has a length which is at least 26 nucleotides. In a related embodiment, each of the first and the second strands has a length which is 26-30 nucleotides. Optionally, each of the first and the second strands has a length which is 27 nucleotides.

In certain embodiments, the second strand of the dsRNA includes a sequence selected from SEQ ID NOs: 164, 166, 174, 177, 179, 1975, 1984, 1986, 1987, 1992, 1994, 1998, 224, 2074, 1283, 2136, 246, 2204, 2220, 2227, 2230, 2235 and 2239. In related embodiments, the first strand of the dsRNA includes a sequence selected from SEQ ID NOs: 4517, 4519, 4527, 4530, 4532, 4876, 4885, 4887, 4888, 4893, 4895, 4899, 4577, 4975, 4778, 5037, 4599, 5105, 5121, 5128, 5131, 5136 and 5140. In a further embodiment, the dsRNA includes a pair of first strand and corresponding second strand sequences selected from Tables 2, 3, 5, 7, 9 and 11.

Another aspect of the invention provides an isolated double stranded ribonucleic acid (dsRNA) comprising first and second nucleic acid strands, wherein the dsRNA comprises a blunt end, wherein each of the first and second oligonucleotide strands consists of the same number of nucleotide residues and is at most 35 nucleotides in length, wherein the ultimate and penultimate residues of the 3' terminus of the first strand and the ultimate and penultimate residues of said 5' terminus of the second strand form one or two mismatched based pairs, wherein the second oligonucleotide strand is sufficiently complementary to a target AR cDNA sequence of Table 13 along at least 19 nucleotides of the second oligonucleotide strand length to reduce AR target gene expression when the double stranded nucleic acid is introduced into a mammalian cell.

In one embodiment, the first strand includes a sequence of SEQ ID NOs: 3794, 3796, 3804, 3807, 3809, 4153, 4162, 4164, 4165, 4170, 4172, 4176, 3854, 4252, 4055, 4314, 3876, 4382, 4398, 4405, 4408, 4413 and 4417.

In an additional aspect, the invention provides a composition possessing AR inhibitory activity consisting essentially of an isolated double stranded ribonucleic acid (dsRNA) comprising first and second nucleic acid strands, wherein the dsRNA comprises blunt ends, wherein each of the first and second oligonucleotide strands consists of the same number of nucleotide residues and is at most 35 nucleotides in length, wherein the second oligonucleotide strand is sufficiently complementary to a target AR cDNA sequence of Table 13 along at least 19 nucleotides of the second oligonucleotide strand length to reduce AR target gene expression when the double stranded nucleic acid is introduced into a mammalian cell.

In another aspect, the invention provides an isolated dsRNA molecule consisting of a sense region and an antisense region, where the sense region and the antisense region together form a duplex region consisting of 15-35 base pairs and the antisense region includes a sequence that is the complement of a sequence of Table 13, and the isolated dsRNA further includes from zero to two 3' overhang regions where each overhang region is six or fewer nucleotides in length. Optionally, the duplex region consists of 19-35 base pairs. In certain embodiments, the duplex region consists of 25-35 base pairs. In additional embodiments, the duplex region consists of 25-30 base pairs.

In a further aspect, the invention provides a siRNA molecule consisting of a sense region and an antisense region, where the sense region and the antisense region together form a duplex region consisting of 19-23 base pairs and the antisense region includes a sequence that is the complement of a sequence of Table 13, and the isolated dsRNA further includes from zero to four overhang regions, where each overhang region is six or fewer nucleotides in length.

In certain aspects, the invention is directed to Dicer substrate siRNAs ("DsiRNAs") with structures and modification patterns that act as effective and highly potent AR inhibitory agents, optionally possessing extended duration of inhibitory effect. A number of such DsiRNAs possess target-specific inhibitory potencies and efficacies that are significantly enhanced relative to 19-23 base pair double stranded nucleic acids (e.g., 21 nucleotide siRNAs) directed against the same target RNA. In certain such embodiments, such a DsiRNA is more potent at reducing AR target gene expression in a mammalian cell than a 19, 20, 21, 22 or 23 base pair sequence that is contained within it, when suitably formulated at a concentration of 1 nM or less.

In a further aspect, the invention provides an isolated double stranded ribonucleic acid (dsRNA) comprising first and second nucleic acid strands and a duplex region of at least 25 base pairs, wherein the first strand is 25-34 nucleotides in length and the second strand is 26-35 nucleotides in length and comprises 1-5 single-stranded nucleotides at its 3' terminus, wherein the second oligonucleotide strand is sufficiently complementary to a target AR cDNA sequence of SEQ ID NOs: 307-459, 826-915, 1024-1077, 1312-1374, 2311-2715 or 3622-3669 along at least 15 nucleotides of the second oligonucleotide strand length to reduce AR target gene expression when the double stranded nucleic acid is introduced into a mammalian cell. Optionally, the second oligonucleotide strand is complementary to a target AR cDNA sequence of SEQ ID NOs: 3766, 3768 or 3770 along at most 27 nucleotides of the second oligonucleotide strand length.

In one embodiment, starting from the first nucleotide (position 1) at the 3' terminus of the first oligonucleotide strand, position 1, 2 and/or 3 is substituted with a modified nucleotide. In certain embodiments, the modified nucleotide residue of the 3' terminus of the first strand is a deoxyribonucleotide, an acyclonucleotide or a fluorescent molecule. In a related embodiment, position 1 of the 3' terminus of the first oligonucleotide strand is a deoxyribonucleotide.

In an additional embodiment, the 3' terminus of the first strand and the 5' terminus of the second strand form a blunt end.

In another embodiment, the first strand is 25 nucleotides in length and the second strand is 27 nucleotides in length.

In one embodiment, the second strand includes a sequence of SEQ ID NOs: 154-306, 796-825, 970-1023, 1249-1311, 1906-2310 and 3574-3621.

In another embodiment, the first strand includes a sequence of SEQ ID NOs: 1-153, 766-795, 916-969, 1186-1248, 1501-1905 and 3526-3573.

In an additional embodiment, the dsRNA includes a pair of first strand/second strand sequences as shown for a DsiRNA agent of Table 9.

In one embodiment, each of the first and the second strands has a length which is at least 26 nucleotides.

In another embodiment, the nucleotides of the 3' overhang include a modified nucleotide. Optionally, the modified nucleotide of the 3' overhang is a 2'-O-methyl ribonucleotide. In a related embodiment, all nucleotides of the 3' overhang are modified nucleotides.

In an additional embodiment, one or both of the first and second oligonucleotide strands includes a 5' phosphate.

In another embodiment, the modified nucleotide residues of the dsRNA are 2'-O-methyl, 2'-methoxyethoxy, 2'-fluoro, 2'-allyl, 2'-O-[2-(methylamino)-2-oxoethyl], 4'-thio, 4'-CH2-O-2'-bridge, 4'-(CH2)2-O-2'-bridge, 2'-LNA, 2'-amino or 2'-O—(N-methlycarbamate).

In one embodiment, the 3' overhang of the dsRNA is 1-3 nucleotides in length. Optionally, the 3' overhang is 1-2 nucleotides in length. In a related embodiment, the 3' overhang is two nucleotides in length and the modified nucleotide of the 3' overhang is a 2'-O-methyl modified ribonucleotide.

In a further embodiment, the second oligonucleotide strand, starting from the nucleotide residue of the second strand that is complementary to the 5' terminal nucleotide residue of the first oligonucleotide strand, includes alternating modified and unmodified nucleotide residues. In another embodiment, the second oligonucleotide strand, starting from the nucleotide residue of the second strand that is complementary to the 5' terminal nucleotide residue of the first oligonucleotide strand, includes unmodified nucleotide residues at all positions from position 18 to the 5' terminus of the second oligonucleotide strand.

In another embodiment, each of the first and the second strands has a length which is at least 26 and at most 30 nucleotides.

In one embodiment, the dsRNA is cleaved endogenously in the cell by Dicer.

In an additional embodiment, the amount of the isolated double stranded nucleic acid sufficient to reduce expression of the target gene is 1 nanomolar or less, 200 picomolar or less, 100 picomolar or less, 50 picomolar or less, 20 picomolar or less, 10 picomolar or less, 5 picomolar or less, 2 picomolar or less or 1 picomolar or less in the environment of the cell.

In a further embodiment, the isolated dsRNA possesses greater potency than isolated 21mer siRNAs directed to the identical at least 15 nucleotides of the target AR cDNA in reducing target AR gene expression when assayed in vitro in a mammalian cell at an effective concentration in the environment of a cell of 1 nanomolar or less, 200 picomolar or less, 100 picomolar or less, 50 picomolar or less, 20 picomolar or less, 10 picomolar or less, 5 picomolar or less, 2 picomolar or less or 1 picomolar or less.

In another embodiment, the isolated dsRNA is sufficiently complementary to the target AR cDNA sequence to reduce AR target gene expression by at least 10%, at least 50%, at least 80-90%, at least 95%, at least 98%, or at least 99% when the double stranded nucleic acid is introduced into a mammalian cell.

In a further embodiment, the first and second strands are joined by a chemical linker. In a related embodiment, the 3' terminus of the first strand and the 5' terminus of the second strand are joined by a chemical linker.

In one embodiment, a nucleotide of the second or first strand is substituted with a modified nucleotide that directs the orientation of Dicer cleavage.

In another embodiment, the dsRNA has a modified nucleotide that is a deoxyribonucleotide, a dideoxyribonucleotide, an acyclonucleotide, a 3'-deoxyadenosine (cordycepin), a 3'-azido-3'-deoxythymidine (AZT), a 2',3'-dideoxyinosine (ddI), a 2',3'-dideoxy-3'-thiacytidine (3TC), a 2',3'-didehydro-2',3'-dideoxythymidine (d4T), a monophosphate nucleotide of 3'-azido-3'-deoxythymidine (AZT), a 2',3'-dideoxy-3'-thiacytidine (3TC) and a monophosphate nucleotide of 2',3'-didehydro-2',3'-dideoxythymidine (d4T), a 4-thiouracil, a 5-bromouracil, a 5-iodouracil, a 5-(3-aminoallyl)-uracil, a 2'-O-alkyl ribonucleotide, a 2'-O-methyl ribonucleotide, a 2'-amino ribonucleotide, a 2'-fluoro ribonucleotide, or a locked nucleic acid.

In an additional embodiment, the dsRNA has a phosphonate, a phosphorothioate or a phosphotriesterphosphate backbone modification.

In one embodiment, the invention provides a method for reducing expression of a target AR gene in a mammalian cell having contacting a mammalian cell in vitro with an isolated dsRNA as described in an amount sufficient to reduce expression of a target AR gene in the cell.

In one embodiment, target AR gene expression is reduced by at least 10%, at least 50%, or at least 80-90%. In another embodiment, target AR mRNA levels are reduced at least 90% at least 8 days after the cell is contacted with the dsRNA. In a further embodiment, AR mRNA levels are reduced by at least 70% at least 10 days after the cell is contacted with the dsRNA.

In a further embodiment, the invention provides a method for reducing expression of a target AR gene in a mammal by administering an isolated dsRNA as described to a mammal in an amount sufficient to reduce expression of a target AR gene in the mammal.

In one embodiment, the isolated dsRNA is administered at a dosage of 1 microgram to 5 milligrams per kilogram of the mammal per day, 100 micrograms to 0.5 milligrams per kilogram, 0.001 to 0.25 milligrams per kilogram, 0.01 to 20 micrograms per kilogram, 0.01 to 10 micrograms per kilogram, 0.10 to 5 micrograms per kilogram, or 0.1 to 2.5 micrograms per kilogram.

In another embodiment, the isolated dsRNA possesses greater potency than isolated 21mer siRNAs directed to the identical at least 15 nucleotides of the target AR cDNA in reducing target AR gene expression when assayed in vitro in a mammalian cell at an effective concentration in the environment of a cell of 1 nanomolar or less.

In an additional embodiment, the administering step includes intravenous injection, intramuscular injection, intraperitoneal injection, infusion, subcutaneous injection, transdermal, aerosol, rectal, vaginal, topical, oral or inhaled delivery.

In a further embodiment, the invention provides a method for selectively inhibiting the growth of a cell by contacting a cell with an amount of an isolated dsRNA as described, in an amount sufficient to inhibit the growth of the cell.

In one embodiment, the cell is a tumor cell of a subject. Optionally, the cell is a tumor cell in vitro. In a related embodiment, the cell is a human cell.

In an additional embodiment, the invention provides a formulation which includes an isolated dsRNA as described, where the dsRNA is present in an amount effective to reduce target AR RNA levels when the dsRNA is introduced into a mammalian cell in vitro by at least 10%, at least 50% or at least 80-90%, and where the dsRNA possesses greater potency than isolated 21mer siRNAs directed to the identical at least 15 nucleotides of the target AR cDNA in reducing target AR RNA levels when assayed in vitro in a mammalian cell at an effective concentration in the environment of a cell of 1 nanomolar or less.

In one embodiment, the effective amount is 1 nanomolar or less, 200 picomolar or less, 100 picomolar or less, 50 picomolar or less, 20 picomolar or less, 10 picomolar or less, 5 picomolar or less, 2 picomolar or less or 1 picomolar or less in the environment of the cell.

In another embodiment, the invention provides a formulation which includes an isolated dsRNA as described, where the dsRNA is present in an amount effective to reduce target RNA levels when the dsRNA is introduced into a cell of a mammalian subject by at least 10%, at least 50% or at least 80-90%, and where the dsRNA possesses greater potency than isolated 21mer siRNAs directed to the identical at least 15 nucleotides of the target AR cDNA in reducing target AR RNA levels when assayed in vitro in a mammalian cell at an effective concentration in the environment of a cell of 1 nanomolar or less.

In one embodiment, the effective amount is a dosage of 1 microgram to 5 milligrams per kilogram of the subject per day, 100 micrograms to 0.5 milligrams per kilogram, 0.001 to 0.25 milligrams per kilogram, 0.01 to 20 micrograms per kilogram, 0.01 to 10 micrograms per kilogram, 0.10 to 5 micrograms per kilogram, or 0.1 to 2.5 micrograms per kilogram.

In an additional embodiment, the invention provides a mammalian cell containing an isolated dsRNA as described.

Another embodiment of the invention provides a pharmaceutical composition which includes an isolated dsRNA as described and a pharmaceutically acceptable carrier. A further embodiment of the invention provides a kit having an isolated dsRNA as described and instructions for its use.

In an additional aspect, the invention provides a composition possessing AR inhibitory activity consisting essentially of an isolated double stranded ribonucleic acid (dsRNA) comprising first and second nucleic acid strands and a duplex region of at least 25 base pairs, wherein the first strand is 25-34 nucleotides in length and the second strand is 26-35 nucleotides in length and comprises 1-5 single-stranded nucleotides at its 3' terminus, wherein the second oligonucleotide strand is sufficiently complementary to a target AR cDNA sequence of SEQ ID NOs: 307-459, 826-915, 1024-1077, 1312-1374, 2311-2715 or 3622-3669 along at least 15 nucleotides of the second oligonucleotide strand length to reduce AR target gene expression when the double stranded nucleic acid is introduced into a mammalian cell.

In another embodiment, the invention provides a method for treating or preventing an AR-associated disease or disorder in a subject by administering a dsRNA and/or dsRNA-containing composition of the invention and a pharmaceutically acceptable carrier to a subject in an amount sufficient to treat or prevent an AR-associated disease or disorder in the subject. In a related embodiment, the AR-associated disease or disorder is prostate cancer.

In another aspect, the invention provides an isolated double stranded ribonucleic acid (dsRNA) comprising first and second nucleic acid strands and a duplex region of at least 25 base pairs, wherein the dsRNA comprises blunt ends, wherein each of the first and second oligonucleotide strands consists of the same number of nucleotide residues and is at most 35 nucleotides in length, wherein the second oligonucleotide strand is sufficiently complementary to a target AR cDNA sequence of SEQ ID NOs: 307-459, 826-915, 1024-1077, 1312-1374, 2311-2715 or 3622-3669 along at least 15 nucleotides of the second oligonucleotide strand length to reduce AR target gene expression when the double stranded nucleic acid is introduced into a mammalian cell.

In one embodiment, the dsRNA is capable of reducing target gene expression at a concentration of less than 1 nanomolar in the environment of a cell. In another embodiment, each of the first and the second strands has a length which is at least 26 nucleotides. In a related embodiment, each of the first and the second strands has a length which is 26-30 nucleotides. Optionally, each of the first and the second strands has a length which is 27 nucleotides.

In certain embodiments, the second strand of the dsRNA includes a sequence selected from SEQ ID NOs: 154-306, 796-825, 970-1023, 1249-1311, 1906-2310 and 3574-3621. (Optionally, the second strand is a sequence selected from SEQ ID NOs: 154-306, 796-825, 970-1023, 1249-1311, 1906-2310 and 3574-3621.) In related embodiments, the first strand of the dsRNA includes a sequence selected from SEQ ID NOs: 3784-5229. (Optionally, the first strand is a sequence selected from SEQ ID NOs: 3784-5229.) In a further embodiment, the dsRNA includes a pair of first strand and corresponding second strand sequences selected from Tables 5-8.

Another aspect of the invention provides an isolated double stranded ribonucleic acid (dsRNA) comprising first and second nucleic acid strands and a duplex region of at least 25 base pairs, wherein the dsRNA comprises a blunt end, wherein each of the first and second oligonucleotide strands consists of the same number of nucleotide residues and is at most 35 nucleotides in length, wherein the ultimate and penultimate residues of the 3' terminus of the first strand and the ultimate and penultimate residues of said 5' terminus of the second strand form one or two mismatched based pairs. wherein the second oligonucleotide strand is sufficiently complementary to a target AR cDNA sequence of SEQ ID NOs: 307-459, 826-915, 1024-1077, 1312-1374, 2311-2715 or 3622-3669 along at least 15 nucleotides of the second oligonucleotide strand length to reduce AR target gene expression when the double stranded nucleic acid is introduced into a mammalian cell.

In one embodiment, the first strand includes a sequence of SEQ ID NOs: 3784-4506.

In an additional aspect, the invention provides a composition possessing AR inhibitory activity consisting essentially of an isolated double stranded ribonucleic acid (dsRNA) comprising first and second nucleic acid strands and a duplex region of at least 25 base pairs, wherein said dsRNA comprises blunt ends, wherein each of the first and second oligonucleotide strands consists of the same number of nucleotide residues and is at most 35 nucleotides in length, wherein the second oligonucleotide strand is sufficiently complementary to a target AR cDNA sequence of SEQ ID NOs: 307-459, 826-915, 1024-1077, 1312-1374, 2311-2715 or 3622-3669 along at least 15 nucleotides of the second oligonucleotide strand length to reduce AR target gene expression when the double stranded nucleic acid is introduced into a mammalian cell.

In another aspect, the invention provides an isolated dsRNA molecule consisting of a sense region and an antisense region, where the sense region and the antisense region together form a duplex region consisting of 19-35 base pairs and the antisense region includes a sequence that is the complement of SEQ ID NOs 613-765, 886-915, 1132-1185, 1438-1500 or 3121-3765, and the isolated dsRNA further includes from zero to two 3' overhang regions where each overhang region is six or fewer nucleotides in length. Optionally, the duplex region consists of 25-35 base pairs.

In a further aspect, the invention provides a siRNA molecule consisting of a sense region and an antisense region, where the sense region and the antisense region together form a duplex region consisting of 19-23 base pairs and the antisense region includes a sequence that is the complement of SEQ ID NOs 613-765, 886-915, 1132-1185, 1438-1500 or 3121-3765, and the isolated dsRNA further includes from zero to four overhang regions, where each overhang region is six or fewer nucleotides in length.

The present invention is also directed to compounds, compositions, and methods relating to traits, diseases and conditions that respond to the modulation of expression and/or activity of genes involved in AR gene expression pathways or other cellular processes that mediate the maintenance or development of such traits, diseases and conditions. Specifically, the invention relates to small nucleic acid molecules that are capable of being processed by the Dicer enzyme, such as Dicer substrate siRNAs (DsiRNAs) capable of mediating RNA interference (RNAi) against AR gene expression. Such anti-AR DsiRNAs are useful, for example, in providing compositions for treatment of traits, diseases and conditions that can respond to modulation of AR in a subject, such as cancer and/or other proliferative diseases, disorders, or conditions. Efficacy, potency, toxicity and other effects of an anti-AR DsiRNA can be examined in one or more animal models of proliferative disease (exemplary animal models of proliferative disease are recited below).

BRIEF DESCRIPTION OF THE DRAWINGS

FIG. 1 shows the structures of exemplary DsiRNA agents targeting a site in the AR RNA referred to herein as the "AR-770" target site. UPPER case=unmodified RNA, lower case=DNA, Bold=mismatch base pair nucleotides; arrowheads indicate projected Dicer enzyme cleavage sites; dashed line indicates sense strand (top strand) sequences corresponding to the projected Argonaute 2 (Ago2) cleavage site within the targeted AR sequence.

FIGS. 4 and 5 show histograms of mouse AR inhibitory efficacies observed for indicated DsiRNAs. "P1" indicates phase 1, while "P2" indicates phase 2. In phase 1, DsiRNAs were tested at 1 nM in the environment of LMTK-cells. In phase 2, DsiRNAs were tested at 1 nM, at 0.3 nM and at 0.1 nM in the environment of LMTK-cells. Individual bars represent average mouse AR levels observed in triplicate, with standard errors shown. Mouse AR levels were normalized to HPRT and Rp123 levels.

FIG. 6A shows that proteins corresponding to both long and short forms of AR transcript were effectively knocked down at 24 and 48 hours post-administration by AR-targeting DsiRNAs AR-2224 and AR-2213, whereas only protein corresponding to the long form of the AR transcript was effectively knocked down by AR-targeting DsiRNAs AR-3518 and AR-3242. FIG. 6B depicts DsiRNA Targeted Locations in AR mRNAs expressed in 22Rv1 cells.

FIGS. 7-1 to 7-32 present bar graphs showing efficacy data for six different modification patterns each across 32 AR-targeting DsiRNAs in human A549 cells at 0.1 nM (parallel assays) and 1 nM.

FIG. 8 presents a histogram showing that an exemplary AR-targeting DsiRNA, AR-2813, effectively reduced AR levels in lung tissues of mice administered AR-2813, as compared to mock- and control DsiRNA-treated mice. (Results for each of three parallel qPCR assays of AR levels as indicated are shown.)

FIG. 9 demonstrates administration of AR-2813 DsiRNA produced effective inhibition of both AR mRNA (lower panel) and protein (top panels) in the human prostate cancer cell line 22Rv1, with 24 h (Day 1) and 48 h (Day 2) timepoints post-administration shown.

FIG. 10 shows dose-response curves for five DsiRNAs assayed in A549 cells (adenocarcinomic human alveolar basal epithelial cells) for reduction of AR mRNA levels. $IC_{50}$ values were calculated for each of the assayed AR-targeting DsiRNAs: AR-2813-M25 ($IC_{50}$=21 pM), AR-2815-M12 ($IC_{50}$=0.7 pM), AR-2874-M12 ($IC_{50}$=0.4 pM), AR-3518-M12 ($IC_{50}$=0.086 pM) and AR-3599-M25 ($IC_{50}$=1.57 pM).

FIG. 11 shows that AR-targeting DsiRNAs (here, the AR-2813 DsiRNA) inhibited cell growth following administration to 22Rv1 (human prostate cancer) cells.

FIG. 12 shows that AR-targeting DsiRNAs (here, the AR-3599 and AR-2813 DsiRNAs, where the antisense (guide) strand carries the M25 modification pattern as shown in FIG. 7) inhibited cell growth following administration to VCaP (human prostate cancer) cells. Cell growth values were assessed at five days post-transfection-mediated administration of DsiRNAs.

FIG. 13 demonstrates that four distinct AR-targeting DsiRNAs (AR-2815-M12, AR-2874-M12, AR-3518-M12 and AR3599-M25) each reduced AR mRNA expression in normal liver tissue by at least 80% (in certain cases, at least 90% or even 95%) as compared to a PBS- or control oligonucleotide-treated control. DsiRNAs were formulated in InVivoFectamine™ (InVitrogen) 2.0 transfection agent and were administered to two month old nu/nu male mice (n=7) at 10 mg/kg by i.v. injection on day 1 and day 4, with tissue harvested 48 hours after administration of the second dose.

FIG. 14 shows that AR-targeting DsiRNAs (AR-2815-M12 and AR3599-M25) reduced AR mRNA expression in normal liver tissue by at least 80% (in one case, at least 90%) as compared to a saline- or control oligonucleotide-treated control. DsiRNAs were formulated in lipid formulation "DL1" and were administered to mice at 5 mg/kg by i.v. injection in a series of three doses at timepoints 0, 48 hours and 96 hours, with tissue harvested at 48 hours after administration of the final dose.

DETAILED DESCRIPTION OF THE INVENTION

Figure 2:
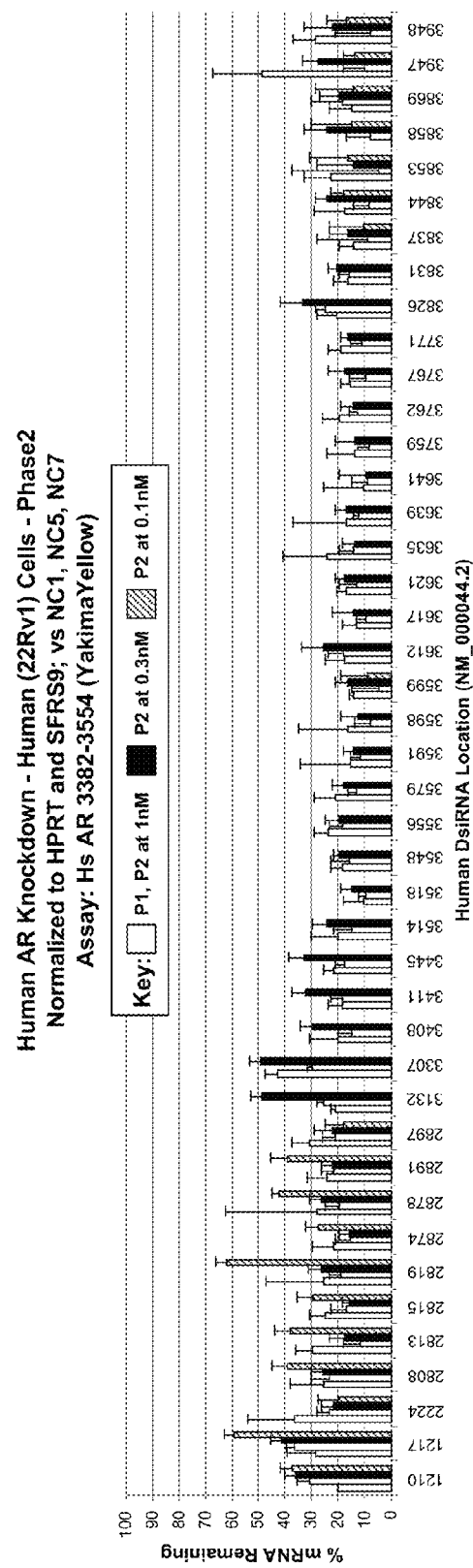
FIGS. 2 and 3 show histograms of human AR inhibitory efficacies observed for indicated DsiRNAs. "P1" indicates phase 1, while "P2" indicates phase 2. In phase 1, DsiRNAs were tested at 1 nM in the environment of 22Rv1 cells. In phase 2, DsiRNAs were tested at 1 nM, at 0.3 nM and at 0.1 nM in the environment of 22Rv1 cells. Individual bars represent average human AR levels observed in triplicate, with standard errors shown. Human AR levels were normalized to HPRT and SFRS9 levels.

The present invention is directed to compositions that contain double stranded RNA ("dsRNA"), and methods for preparing them, that are capable of reducing the level and/or expression of the AR gene in vivo or in vitro. One of the strands of the dsRNA contains a region of nucleotide sequence that has a length that ranges from 19 to 35 nucleotides that can direct the destruction and/or translational inhibition of the targeted AR transcript.

Definitions

Unless defined otherwise, all technical and scientific terms used herein have the meaning commonly understood by a person skilled in the art to which this invention belongs. The following references provide one of skill with a general definition of many of the terms used in this invention: Singleton et al., Dictionary of Microbiology and Molecular Biology (2nd ed. 1994); The Cambridge Dictionary of Science and Technology (Walker ed., 1988); The Glossary of Genetics, 5th Ed., R. Rieger et al. (eds.), Springer Verlag (1991); and Hale & Marham, The Harper Collins Dictionary of Biology (1991). As used herein, the following terms have the meanings ascribed to them below, unless specified otherwise.

The present invention features one or more DsiRNA molecules that can modulate (e.g., inhibit) AR expression. The DsiRNAs of the invention optionally can be used in combination with modulators of other genes and/or gene products associated with the maintenance or development of diseases or disorders associated with AR misregulation (e.g., tumor formation and/or growth, etc.). The DsiRNA agents of the invention modulate AR RNAs such as those corresponding to the cDNA sequences referred to by GenBank Accession Nos. NM_000044.2 (human AR, long version), NM_001011645.1 (human AR, short version) and NM_013476.3 (mouse AR), which are recited below and referred to herein generally as "AR."

The below description of the various aspects and embodiments of the invention is provided with reference to exemplary AR RNAs, generally referred to herein as AR. However, such reference is meant to be exemplary only and the various aspects and embodiments of the invention are also directed to alternate AR RNAs, such as mutant AR RNAs or additional AR splice variants. Certain aspects and embodiments are also directed to other genes involved in AR pathways, including genes whose misregulation acts in association with that of AR (or is affected or affects AR regulation) to produce phenotypic effects that may be targeted for treatment (e.g., tumor formation and/or growth, etc.). Such additional genes can be targeted using DsiRNA and the methods described herein for use of AR targeting DsiRNAs. Thus, the inhibition and the effects of such inhibition of the other genes can be performed as described herein.

The term "AR" refers to nucleic acid sequences encoding an AR protein, peptide, or polypeptide (e.g., AR transcripts, such as the sequences of AR Genbank Accession Nos. NM_000044.2, NM_001011645.1 and NM_013476.3). In certain embodiments, the term "AR" is also meant to include other AR encoding sequence, such as other AR isoforms, mutant AR genes, splice variants of AR genes, and AR gene polymorphisms. The term "AR" is used to refer to the polypeptide gene product of an AR gene/transcript, e.g., an AR protein, peptide, or polypeptide, such as those encoded by AR Genbank Accession Nos. NM_000044.2, NM_001011645.1 and NM_013476.3.

As used herein, an "AR-associated disease or disorder" refers to a disease or disorder known in the art to be associated with altered AR expression, level and/or activity. Notably, an "AR-associated disease or disorder" includes cancer and/or proliferative diseases, conditions, or disorders. An exemplary "AR-associated disease or disorder" is prostate cancer.

By "proliferative disease" or "cancer" as used herein is meant, a disease, condition, trait, genotype or phenotype characterized by unregulated cell growth or replication as is known in the art; including leukemias, for example, acute myelogenous leukemia (AML), chronic myelogenous leukemia (CML), acute lymphocytic leukemia (ALL), and chronic lymphocytic leukemia, AIDS related cancers such as Kaposi's sarcoma; breast cancers; bone cancers such as Osteosarcoma, Chondrosarcomas, Ewing's sarcoma, Fibrosarcomas, Giant cell tumors, Adamantinomas, and Chordomas; Brain cancers such as Meningiomas, Glioblastomas, Lower-Grade Astrocytomas, Oligodendrocytomas, Pituitary Tumors, Schwannomas, and Metastatic brain cancers; cancers of the head and neck including various lymphomas such as mantle cell lymphoma, non-Hodgkins lymphoma, adenoma, squamous cell carcinoma, laryngeal carcinoma, gallbladder and bile duct cancers, cancers of the retina such as retinoblastoma, cancers of the esophagus, gastric cancers, multiple myeloma, ovarian cancer, uterine cancer, thyroid cancer, testicular cancer, endometrial cancer, melanoma, colorectal cancer, lung cancer, bladder cancer, prostate cancer, lung cancer (including non-small cell lung carcinoma), pancreatic cancer, sarcomas, Wilms' tumor, cervical cancer, head and neck cancer, skin cancers, nasopharyngeal carcinoma, liposarcoma, epithelial carcinoma, renal cell carcinoma, gallbladder adeno carcinoma, parotid adenocarcinoma, endometrial sarcoma, multidrug resistant cancers; and proliferative diseases and conditions, such as neovascularization associated with tumor angiogenesis, macular degeneration (e.g., wet/dry AMD), corneal neovascularization, diabetic retinopathy, neovascular glaucoma, myopic degeneration and other proliferative diseases and conditions such as restenosis and polycystic kidney disease, and other cancer or proliferative disease, condition, trait, genotype or phenotype that can respond to the modulation of disease related gene expression in a cell or tissue, alone or in combination with other therapies.

In certain embodiments, dsRNA-mediated inhibition of an AR target sequence is assessed. In such embodiments, AR RNA levels can be assessed by art-recognized methods (e.g., RT-PCR, Northern blot, expression array, etc.), optionally via comparison of AR levels in the presence of an anti-AR dsRNA of the invention relative to the absence of such an anti-AR dsRNA. In certain embodiments, AR levels in the presence of an anti-AR dsRNA are compared to those observed in the presence of vehicle alone, in the presence of a dsRNA directed against an unrelated target RNA, or in the absence of any treatment.

It is also recognized that levels of AR protein can be assessed and that AR protein levels are, under different conditions, either directly or indirectly related to AR RNA levels and/or the extent to which a dsRNA inhibits AR expression, thus art-recognized methods of assessing AR protein levels (e.g., Western blot, immunoprecipitation, other antibody-based methods, etc.) can also be employed to examine the inhibitory effect of a dsRNA of the invention.

An anti-AR dsRNA of the invention is deemed to possess "AR inhibitory activity" if a statistically significant reduction in AR RNA (or when the AR protein is assessed, AR protein levels) is seen when an anti-AR dsRNA of the invention is administered to a system (e.g., cell-free in vitro system), cell, tissue or organism, as compared to a selected control. The distribution of experimental values and the number of replicate assays performed will tend to dictate the parameters of what levels of reduction in AR RNA (either as a % or in absolute terms) is deemed statistically significant (as assessed by standard methods of determining statistical significance known in the art). However, in certain embodiments, "AR inhibitory activity" is defined based upon a % or absolute level of reduction in the level of AR in a system, cell, tissue or organism. For example, in certain embodiments, a DsiRNA of the invention is deemed to possess AR inhibitory activity if at least a 5% reduction or at least a 10% reduction in AR RNA is observed in the presence of a DsiRNA of the invention relative to AR levels seen for a suitable control. (For example, in vivo AR levels in a tissue and/or subject can, in certain embodiments, be deemed to be inhibited by a DsiRNA agent of the invention if, e.g., a 5% or 10% reduction in AR levels is observed relative to a control.) In certain other embodiments, a DsiRNA of the invention is deemed to possess AR inhibitory activity if AR RNA levels are observed to be reduced by at least 15% relative to a selected control, by at least 20% relative to a selected control, by at least 25% relative to a selected control, by at least 30% relative to a selected control, by at least 35% relative to a selected control, by at least 40% relative to a selected control, by at least 45% relative to a selected control, by at least 50% relative to a selected control, by at least 55% relative to a selected control, by at least 60% relative to a selected control, by at least 65% relative to a selected control, by at least 70% relative to a selected control, by at least 75% relative to a selected control, by at least 80% relative to a selected control, by at least 85% relative to a selected control, by at least 90% relative to a selected control, by at least 95% relative to a selected control, by at least 96% relative to a selected control, by at least 97% relative to a selected control, by at least 98% relative to a selected control or by at least 99% relative to a selected control. In some embodiments, complete inhibition of AR is required for a DsiRNA to be deemed to possess AR inhibitory activity. In certain models (e.g., cell culture), a DsiRNA is deemed to possess AR inhibitory activity if at least a 50% reduction in AR levels is observed relative to a suitable control. In certain other embodiments, a DsiRNA is deemed to possess AR inhibitory activity if at least an 80% reduction in AR levels is observed relative to a suitable control.

By way of specific example, in the Examples below, a series of DsiRNAs targeting AR were tested for the ability to reduce AR mRNA levels in human 22Rv1 or mouse LMTK- cells in vitro, at 1 nM concentrations in the environment of such cells and in the presence of a transfection agent (Lipofectamine™ RNAiMAX, Invitrogen). Within the below Examples, AR inhibitory activity was initially ascribed to those DsiRNAs that were observed to effect at least a 70% reduction of AR mRNA levels under the assayed conditions. It is contemplated that AR inhibitory activity could also be attributed to a dsRNA under either more or less stringent conditions than those employed for the Examples below, even when the same or a similar assay and conditions are employed. For example, in certain embodiments, a tested dsRNA of the invention is deemed to possess AR inhibitory activity if at least a 10% reduction, at least a 20% reduction, at least a 30% reduction, at least a 40% reduction, at least a 50% reduction, at least a 60% reduction, at least a 75% reduction, at least an 80% reduction, at least an 85% reduction, at least a 90% reduction, or at least a 95% reduction in AR mRNA levels is observed in a mammalian cell line in vitro at 1 nM dsRNA concentration or lower in the environment of a cell, relative to a suitable control.

Use of other endpoints for determination of whether a double stranded RNA of the invention possesses AR inhibitory activity is also contemplated. Specifically, in one embodiment, in addition to or as an alternative to assessing AR mRNA levels, the ability of a tested dsRNA to reduce AR protein levels (e.g., at 48 hours after contacting a mammalian cell in vitro or in vivo) is assessed, and a tested dsRNA is deemed to possess AR inhibitory activity if at least a 10% reduction, at least a 20% reduction, at least a 30% reduction, at least a 40% reduction, at least a 50% reduction, at least a 60% reduction, at least a 70% reduction, at least a 75% reduction, at least an 80% reduction, at least an 85% reduction, at least a 90% reduction, or at least a 95% reduction in AR protein levels is observed in a mammalian cell contacted with the assayed double stranded RNA in vitro or in vivo, relative to a suitable control. Additional endpoints contemplated include, e.g., assessment of a phenotype associated with reduction of AR levels—e.g., reduction of growth of a contacted mammalian cell line in vitro and/or reduction of growth of a tumor in vivo, including, e.g., halting or reducing the growth of tumor or cancer cell levels as described in greater detail elsewhere herein.

AR inhibitory activity can also be evaluated over time (duration) and over concentration ranges (potency), with assessment of what constitutes a dsRNA possessing AR inhibitory activity adjusted in accordance with concentrations administered and duration of time following administration. Thus, in certain embodiments, a DsiRNA of the invention is deemed to possess AR inhibitory activity if at least a 50% reduction in AR activity is observed at a duration of time of 2 hours, 5 hours, 10 hours, 1 day, 2 days, 3 days, 4 days, 5 days, 6 days, 7 days, 8 days, 9 days, 10 days or more after administration is observed/persists. In additional embodiments, a DsiRNA of the invention is deemed to be a potent AR inhibitory agent if AR inhibitory activity (e.g., in certain embodiments, at least 50% inhibition of AR) is observed at a concentration of 1 nM or less, 500 pM or less, 200 pM or less, 100 pM or less, 50 pM or less, 20 pM or less, 10 pM or less, 5 pM or less, 2 pM or less or even 1 pM or less in the environment of a cell, for example, within an in vitro assay for AR inhibitory activity as described herein. In certain embodiments, a potent AR inhibitory dsRNA of the invention is defined as one that is capable of AR inhibitory activity (e.g., in certain embodiments, at least 20% reduction of AR levels) at a formulated concentration of 10 mg/kg or less when administered to a subject in an effective delivery vehicle (e.g., an effective lipid nanoparticle formulation). Preferably, a potent AR inhibitory dsRNA of the invention is defined as one that is capable of AR inhibitory activity (e.g., in certain embodiments, at least 50% reduction of AR levels) at a formulated concentration of 5 mg/kg or less when administered to a subject in an effective delivery vehicle. More preferably, a potent AR inhibitory dsRNA of the invention is defined as one that is capable of AR inhibitory activity (e.g., in certain embodiments, at least 50% reduction of AR levels) at a formulated concentration of 5 mg/kg or less when administered to a subject in an effective delivery vehicle. Optionally, a potent AR inhibitory dsRNA of the invention is defined as one that is capable of AR inhibitory activity (e.g., in certain embodiments, at least 50% reduction of AR levels) at a formulated concentration of 2 mg/kg or less, or even 1 mg/kg or less, when administered to a subject in an effective delivery vehicle.

In certain embodiments, potency of a dsRNA of the invention is determined in reference to the number of copies of a dsRNA present in the cytoplasm of a target cell that are required to achieve a certain level of target gene knockdown. For example, in certain embodiments, a potent dsRNA is one capable of causing 50% or greater knockdown of a target mRNA when present in the cytoplasm of a target cell at a copy number of 1000 or fewer RISC-loaded antisense strands per cell. More preferably, a potent dsRNA is one capable of producing 50% or greater knockdown of a target mRNA when present in the cytoplasm of a target cell at a copy number of 500 or fewer RISC-loaded antisense strands per cell. Optionally, a potent dsRNA is one capable of producing 50% or greater knockdown of a target mRNA when present in the cytoplasm of a target cell at a copy number of 300 or fewer RISC-loaded antisense strands per cell.

In further embodiments, the potency of a DsiRNA of the invention can be defined in reference to a 19 to 23mer dsRNA directed to the same target sequence within the same target gene. For example, a DsiRNA of the invention that possesses enhanced potency relative to a corresponding 19 to 23mer dsRNA can be a DsiRNA that reduces a target gene by an additional 5% or more, an additional 10% or more, an additional 20% or more, an additional 30% or more, an additional 40% or more, or an additional 50% or more as compared to a corresponding 19 to 23mer dsRNA, when assayed in an in vitro assay as described herein at a sufficiently low concentration to allow for detection of a potency difference (e.g., transfection concentrations at or below 1 nM in the environment of a cell, at or below 100 pM in the environment of a cell, at or below 10 pM in the environment of a cell, at or below 1 nM in the environment of a cell, in an in vitro assay as described herein; notably, it is recognized that potency differences can be best detected via performance of such assays across a range of concentrations—e.g., 0.1 pM to 10 nM—for purpose of generating a dose-response curve and identifying an IC50 value associated with a DsiRNA/dsRNA).

AR inhibitory levels and/or AR levels may also be assessed indirectly, e.g., measurement of a reduction in PSA levels or reduction of the size or number of polyps or tumors in a subject may be used to assess AR levels and/or AR inhibitory efficacy of a double-stranded nucleic acid of the instant invention.

In certain embodiments, the phrase "consists essentially of" is used in reference to the anti-AR dsRNAs of the invention. In some such embodiments, "consists essentially of" refers to a composition that comprises a dsRNA of the invention which possess at least a certain level of AR inhibitory activity (e.g., at least 50% AR inhibitory activity) and that also comprises one or more additional components and/or modifications that do not significantly impact the AR inhibitory activity of the dsRNA. For example, in certain embodiments, a composition "consists essentially of" a dsRNA of the invention where modifications of the dsRNA of the invention and/or dsRNA-associated components of the composition do not alter the AR inhibitory activity (optionally including potency or duration of AR inhibitory activity) by greater than 3%, greater than 5%, greater than 10%, greater than 15%, greater than 20%, greater than 25%, greater than 30%, greater than 35%, greater than 40%, greater than 45%, or greater than 50% relative to the dsRNA of the invention in isolation. In certain embodiments, a composition is deemed to consist essentially of a dsRNA of the invention even if more dramatic reduction of AR inhibitory activity (e.g., 80% reduction, 90% reduction, etc. in efficacy, duration and/or potency) occurs in the presence of additional components or modifications, yet where AR inhibitory activity is not significantly elevated (e.g., observed levels of AR inhibitory activity are within 10% those observed for the isolated dsRNA of the invention) in the presence of additional components and/or modifications.

As used herein, the phrase "dsRNA reduces AR mRNA levels by at least X % when assayed in vitro in a mammalian cell at an effective concentration in the environment of said cell of 1 nanomolar or less" refers to a requirement for the dsRNA to reduce the native AR mRNA levels of a HeLa cell population by at least X %, when assayed at a transfection concentration of 1 nanomolar or less in the presence of Lipofectamine™ RNAiMAX (Invitrogen) and following manufacturer's instructions. Such HeLa cells are obtained from ATCC and maintained in DMEM (HyClone) supplemented with 10% fetal bovine serum (HyClone) at 37° C. under 5% $CO_2$. AR mRNA levels are then assayed at 24 h or 48 h post-transfection to assess % inhibition, with respect to an appropriate control as described elsewhere herein. In certain embodiments, the HeLa cells of such assays are replaced with HepG2, HCT116, HuH7 or other cell line.

As used herein, the term "nucleic acid" refers to deoxyribonucleotides, ribonucleotides, or modified nucleotides, and polymers thereof in single- or double-stranded form. The term encompasses nucleic acids containing known nucleotide analogs or modified backbone residues or linkages, which are synthetic, naturally occurring, and non-naturally occurring, which have similar binding properties as the reference nucleic acid, and which are metabolized in a manner similar to the reference nucleotides. Examples of such analogs include, without limitation, phosphorothioates, phosphoramidates, methyl phosphonates, chiral-methyl phosphonates, 2-O-methyl ribonucleotides, peptide-nucleic acids (PNAs).

As used herein, "nucleotide" is used as recognized in the art to include those with natural bases (standard), and modified bases well known in the art. Such bases are generally located at the 1' position of a nucleotide sugar moiety. Nucleotides generally comprise a base, sugar and a phosphate group. The nucleotides can be unmodified or modified at the sugar, phosphate and/or base moiety, (also referred to interchangeably as nucleotide analogs, modified nucleotides, non-natural nucleotides, non-standard nucleotides and other; see, e.g., Usman and McSwiggen, supra; Eckstein, et al., International PCT Publication No. WO 92/07065; Usman et al, International PCT Publication No. WO 93/15187; Uhlman & Peyman, supra, all are hereby incorporated by reference herein). There are several examples of modified nucleic acid bases known in the art as summarized by Limbach, et al, Nucleic Acids Res. 22:2183, 1994. Some of the non-limiting examples of base modifications that can be introduced into nucleic acid molecules include, hypoxanthine, purine, pyridin-4-one, pyridin-2-one, phenyl, pseudouracil, 2,4,6-trimethoxy benzene, 3-methyl uracil, dihydrouridine, naphthyl, aminophenyl, 5-alkylcytidines (e.g., 5-methylcytidine), 5-alkyluridines (e.g., ribothymidine), 5-halouridine (e.g., 5-bromouridine) or 6-azapyrimidines or 6-alkylpyrimidines (e.g. 6-methyluridine), propyne, and others (Burgin, et al., Biochemistry 35:14090, 1996; Uhlman & Peyman, supra). By "modified bases" in this aspect is meant nucleotide bases other than adenine, guanine, cytosine and uracil at 1' position or their equivalents.

As used herein, "modified nucleotide" refers to a nucleotide that has one or more modifications to the nucleoside, the nucleobase, pentose ring, or phosphate group. For example, modified nucleotides exclude ribonucleotides containing adenosine monophosphate, guanosine monophosphate, uridine monophosphate, and cytidine monophosphate and deoxyribonucleotides containing deoxyadenosine monophosphate, deoxyguanosine monophosphate, deoxythymidine monophosphate, and deoxycytidine monophosphate. Modifications include those naturally occurring that result from modification by enzymes that modify nucleotides, such as methyltransferases. Modified nucleotides also include synthetic or non-naturally occurring nucleotides. Synthetic or non-naturally occurring modifications in nucleotides include those with 2' modifications, e.g., 2'-methoxyethoxy, 2'-fluoro, 2'-allyl, 2'-O-[2-(methylamino)-2-oxoethyl], 4'-thio, 4'-$CH_2$—O-2'-bridge, 4'-$(CH_2)_2$—O-2'-bridge, 2'-LNA, and 2'-O-(N-methylcarbamate) or those comprising base analogs. In connection with 2'-modified nucleotides as described for the present disclosure, by "amino" is meant 2'-$NH_2$ or 2'-O—$NH_2$, which can be modified or unmodified. Such modified groups are described, e.g., in Eckstein et al., U.S. Pat. No. 5,672,695 and Matulic-Adamic et al., U.S. Pat. No. 6,248,878.

In reference to the nucleic acid molecules of the present disclosure, modifications may exist upon these agents in patterns on one or both strands of the double stranded ribonucleic acid (dsRNA). As used herein, "alternating positions" refers to a pattern where every other nucleotide is a modified nucleotide or there is an unmodified nucleotide (e.g., an unmodified ribonucleotide) between every modified nucleotide over a defined length of a strand of the dsRNA (e.g., 5'-MNMNMN-3'; 3'-MNMNMN-5'; where M is a modified nucleotide and N is an unmodified nucleotide). The modification pattern starts from the first nucleotide position at either the 5' or 3' terminus according to a position numbering convention, e.g., as described herein (in certain embodiments, position 1 is designated in reference to the terminal residue of a strand following a projected Dicer cleavage event of a DsiRNA agent of the invention; thus, position 1 does not always constitute a 3' terminal or 5' terminal residue of a pre-processed agent of the invention). The pattern of modified nucleotides at alternating positions may run the full length of the strand, but in certain embodiments includes at least 4, 6, 8, 10, 12, 14 nucleotides containing at least 2, 3, 4, 5, 6 or 7 modified nucleotides, respectively. As used herein, "alternating pairs of positions" refers to a pattern where two consecutive modified nucleotides are separated by two consecutive unmodified nucleotides over a defined length of a strand of the dsRNA (e.g., 5'-MMNNMMNNMMNN-3'; 3'-MMNNMMNNMMNN-5'; where M is a modified nucleotide and N is an unmodified nucleotide). The modification pattern starts from the first nucleotide position at either the 5' or 3' terminus according to a position numbering convention such as those described herein. The pattern of modified nucleotides at alternating positions may run the full length of the strand, but preferably includes at least 8, 12, 16, 20, 24, 28 nucleotides containing at least 4, 6, 8, 10, 12 or 14 modified nucleotides, respectively. It is emphasized that the above modification patterns are exemplary and are not intended as limitations on the scope of the invention.

As used herein, "base analog" refers to a heterocyclic moiety which is located at the 1' position of a nucleotide sugar moiety in a modified nucleotide that can be incorporated into a nucleic acid duplex (or the equivalent position in a nucleotide sugar moiety substitution that can be incorporated into a nucleic acid duplex). In the dsRNAs of the invention, a base analog is generally either a purine or pyrimidine base excluding the common bases guanine (G), cytosine (C), adenine (A), thymine (T), and uracil (U). Base analogs can duplex with other bases or base analogs in dsRNAs. Base analogs include those useful in the compounds and methods of the invention, e.g., those disclosed in U.S. Pat. Nos. 5,432,272 and 6,001,983 to Benner and US Patent Publication No. 20080213891 to Manoharan, which are herein incorporated by reference. Non-limiting examples of bases include hypoxanthine (I), xanthine (X), 3β-D-ribofuranosyl-(2,6-diaminopyrimidine) (K), 3-β-D-ribofuranosyl-(1-methyl-pyrazolo[4,3-d]pyrimidine-5,7(4H,6H)-dione) (P), iso-cytosine (iso-C), iso-guanine (iso-G), 1-β-D-ribofuranosyl-(5-nitroindole), 1-β-D-ribofuranosyl-(3-nitropyrrole), 5-bromouracil, 2-aminopurine, 4-thio-dT, 7-(2-thienyl)-imidazo[4,5-b]pyridine (Ds) and pyrrole-2-carbaldehyde (Pa), 2-amino-6-(2-thienyl)purine (S),2-oxopyridine (Y), difluorotolyl, 4-fluoro-6-methylbenzimidazole, 4-methylbenzimidazole, 3-methyl isocarbostyrilyl, 5-methyl isocarbostyrilyl, and 3-methyl-7-propynyl isocarbostyrilyl, 7-azaindolyl, 6-methyl-7-azaindolyl, imidizopyridinyl, 9-methyl-imidizopyridinyl, pyrrolopyrizinyl, isocarbostyrilyl, 7-propynyl isocarbostyrilyl, propynyl-7-azaindolyl, 2,4,5-trimethylphenyl, 4-methylindolyl, 4,6-dimethylindolyl, phenyl, napthalenyl, anthracenyl, phenanthracenyl, pyrenyl, stilbenzyl, tetracenyl, pentacenyl, and structural derivates thereof (Schweitzer et al., J. Org. Chem., 59:7238-7242 (1994); Berger et al., Nucleic Acids Research, 28(15):2911-2914 (2000); Moran et al., J. Am. Chem. Soc., 119:2056-2057 (1997); Morales et al., J. Am. Chem. Soc., 121:2323-2324 (1999); Guckian et al., J. Am. Chem. Soc., 118:8182-8183 (1996); Morales et al., J. Am.

Chem. Soc., 122(6):1001-1007 (2000); McMinn et al., *J. Am. Chem. Soc.*, 121:11585-11586 (1999); Guckian et al., *J. Org. Chem.*, 63:9652-9656 (1998); Moran et al., *Proc. Natl. Acad. Sci.*, 94:10506-10511 (1997); Das et al., *J. Chem. Soc.*, Perkin Trans., 1:197-206 (2002); Shibata et al., *J. Chem. Soc.*, Perkin Trans., 1: 1605-1611 (2001); Wu et al., *J. Am. Chem. Soc.*, 122(32):7621-7632 (2000); O'Neill et al., *J. Org. Chem.*, 67:5869-5875 (2002); Chaudhuri et al., *J. Am. Chem. Soc.*, 117:10434-10442 (1995); and U.S. Pat. No. 6,218,108.). Base analogs may also be a universal base.

As used herein, "universal base" refers to a heterocyclic moiety located at the 1' position of a nucleotide sugar moiety in a modified nucleotide, or the equivalent position in a nucleotide sugar moiety substitution, that, when present in a nucleic acid duplex, can be positioned opposite more than one type of base without altering the double helical structure (e.g., the structure of the phosphate backbone). Additionally, the universal base does not destroy the ability of the single stranded nucleic acid in which it resides to duplex to a target nucleic acid. The ability of a single stranded nucleic acid containing a universal base to duplex a target nucleic can be assayed by methods apparent to one in the art (e.g., UV absorbance, circular dichroism, gel shift, single stranded nuclease sensitivity, etc.). Additionally, conditions under which duplex formation is observed may be varied to determine duplex stability or formation, e.g., temperature, as melting temperature (Tm) correlates with the stability of nucleic acid duplexes. Compared to a reference single stranded nucleic acid that is exactly complementary to a target nucleic acid, the single stranded nucleic acid containing a universal base forms a duplex with the target nucleic acid that has a lower Tm than a duplex formed with the complementary nucleic acid. However, compared to a reference single stranded nucleic acid in which the universal base has been replaced with a base to generate a single mismatch, the single stranded nucleic acid containing the universal base forms a duplex with the target nucleic acid that has a higher Tm than a duplex formed with the nucleic acid having the mismatched base.

Some universal bases are capable of base pairing by forming hydrogen bonds between the universal base and all of the bases guanine (G), cytosine (C), adenine (A), thymine (T), and uracil (U) under base pair forming conditions. A universal base is not a base that forms a base pair with only one single complementary base. In a duplex, a universal base may form no hydrogen bonds, one hydrogen bond, or more than one hydrogen bond with each of G, C, A, T, and U opposite to it on the opposite strand of a duplex. Preferably, the universal bases does not interact with the base opposite to it on the opposite strand of a duplex. In a duplex, base pairing between a universal base occurs without altering the double helical structure of the phosphate backbone. A universal base may also interact with bases in adjacent nucleotides on the same nucleic acid strand by stacking interactions. Such stacking interactions stabilize the duplex, especially in situations where the universal base does not form any hydrogen bonds with the base positioned opposite to it on the opposite strand of the duplex. Non-limiting examples of universal-binding nucleotides include inosine, 143-D-ribofuranosyl-5-nitroindole, and/or 1-β-D-ribofuranosyl-3-nitropyrrole (US Pat. Appl. Publ. No. 20070254362 to Quay et al.; Van Aerschot et al., An acyclic 5-nitroindazole nucleoside analogue as ambiguous nucleoside. Nucleic Acids Res. 1995 November 11; 23(21):4363-70; Loakes et al., 3-Nitropyrrole and 5-nitroindole as universal bases in primers for DNA sequencing and PCR. Nucleic Acids Res. 1995 Jul. 11; 23(13):2361-6; Loakes and Brown, 5-Nitroindole as an universal base analogue. Nucleic Acids Res. 1994 Oct. 11; 22(20):4039-43).

As used herein, "loop" refers to a structure formed by a single strand of a nucleic acid, in which complementary regions that flank a particular single stranded nucleotide region hybridize in a way that the single stranded nucleotide region between the complementary regions is excluded from duplex formation or Watson-Crick base pairing. A loop is a single stranded nucleotide region of any length. Examples of loops include the unpaired nucleotides present in such structures as hairpins, stem loops, or extended loops.

As used herein, "extended loop" in the context of a dsRNA refers to a single stranded loop and in addition 1, 2, 3, 4, 5, 6 or up to 20 base pairs or duplexes flanking the loop. In an extended loop, nucleotides that flank the loop on the 5' side form a duplex with nucleotides that flank the loop on the 3' side. An extended loop may form a hairpin or stem loop.

As used herein, "tetraloop" in the context of a dsRNA refers to a loop (a single stranded region) consisting of four nucleotides that forms a stable secondary structure that contributes to the stability of an adjacent Watson-Crick hybridized nucleotides. Without being limited to theory, a tetraloop may stabilize an adjacent Watson-Crick base pair by stacking interactions. In addition, interactions among the four nucleotides in a tetraloop include but are not limited to non-Watson-Crick base pairing, stacking interactions, hydrogen bonding, and contact interactions (Cheong et al., *Nature* 1990 Aug. 16; 346(6285):680-2; Heus and Pardi, *Science* 1991 Jul. 12; 253(5016):191-4). A tetraloop confers an increase in the melting temperature (Tm) of an adjacent duplex that is higher than expected from a simple model loop sequence consisting of four random bases. For example, a tetraloop can confer a melting temperature of at least 55° C. in 10 mM $NaHPO_4$ to a hairpin comprising a duplex of at least 2 base pairs in length. A tetraloop may contain ribonucleotides, deoxyribonucleotides, modified nucleotides, and combinations thereof. Examples of RNA tetraloops include the UNCG family of tetraloops (e.g., UUCG), the GNRA family of tetraloops (e.g., GAAA), and the CUUG tetraloop. (Woese et al., Proc Natl Acad Sci USA. 1990 November; 87(21):8467-71; Antao et al., *Nucleic Acids Res.* 1991 Nov. 11; 19(21):5901-5). Examples of DNA tetraloops include the d(GNNA) family of tetraloops (e.g., d(GTTA), the d(GNRA)) family of tetraloops, the d(GNAB) family of tetraloops, the d(CNNG) family of tetraloops, the d(TNCG) family of tetraloops (e.g., d(TTCG)). (Nakano et al. Biochemistry, 41 (48), 14281-14292, 2002.; SHINJI et al. Nippon Kagakkai Koen Yokoshu VOL. 78th; NO. 2; PAGE. 731 (2000).)

As used herein, the term "siRNA" refers to a double stranded nucleic acid in which each strand comprises RNA, RNA analog(s) or RNA and DNA. The siRNA comprises between 19 and 23 nucleotides or comprises 21 nucleotides. The siRNA typically has 2 by overhangs on the 3' ends of each strand such that the duplex region in the siRNA comprises 17-21 nucleotides, or 19 nucleotides. Typically, the antisense strand of the siRNA is sufficiently complementary with the target sequence of the AR gene/RNA.

An anti-AR DsiRNA of the instant invention possesses strand lengths of at least 25 nucleotides. Accordingly, in certain embodiments, an anti-AR DsiRNA contains one oligonucleotide sequence, a first sequence, that is at least 25 nucleotides in length and no longer than 35 or up to 50 or more nucleotides. This sequence of RNA can be between 26 and 35, 26 and 34, 26 and 33, 26 and 32, 26 and 31, 26 and 30, and 26 and 29 nucleotides in length. This sequence can be 27 or 28 nucleotides in length or 27 nucleotides in length. The second sequence of the DsiRNA agent can be a sequence that anneals to the first sequence under biological conditions, such as within the cytoplasm of a eukaryotic cell. Generally, the second oligonucleotide sequence will have at least 19 complementary base pairs with the first oligonucleotide sequence, more typically the second oligonucleotide sequence will have 21 or more complementary base pairs, or 25 or more complementary base pairs with the first oligonucleotide sequence. In one embodiment, the second sequence is the same length as the first sequence, and the DsiRNA agent is blunt ended. In another embodiment, the ends of the DsiRNA agent have one or more overhangs.

In certain embodiments, the first and second oligonucleotide sequences of the DsiRNA agent exist on separate oligonucleotide strands that can be and typically are chemically synthesized. In some embodiments, both strands are between 26 and 35 nucleotides in length. In other embodiments, both strands are between 25 and 30 or 26 and 30 nucleotides in length. In one embodiment, both strands are 27 nucleotides in length, are completely complementary and have blunt ends. In certain embodiments of the instant invention, the first and second sequences of an anti-AR DsiRNA exist on separate RNA oligonucleotides (strands). In one embodiment, one or both oligonucleotide strands are capable of serving as a substrate for Dicer. In other embodiments, at least one modification is present that promotes Dicer to bind to the double-stranded RNA structure in an orientation that maximizes the double-stranded RNA structure's effectiveness in inhibiting gene expression. In certain embodiments of the instant invention, the anti-AR DsiRNA agent is comprised of two oligonucleotide strands of differing lengths, with the anti-AR DsiRNA possessing a blunt end at the 3' terminus of a first strand (sense strand) and a 3' overhang at the 3' terminus of a second strand (antisense strand). The DsiRNA can also contain one or more deoxyribonucleic acid (DNA) base substitutions.

Suitable DsiRNA compositions that contain two separate oligonucleotides can be chemically linked outside their annealing region by chemical linking groups. Many suitable chemical linking groups are known in the art and can be used. Suitable groups will not block Dicer activity on the DsiRNA and will not interfere with the directed destruction of the RNA transcribed from the target gene. Alternatively, the two separate oligonucleotides can be linked by a third oligonucleotide such that a hairpin structure is produced upon annealing of the two oligonucleotides making up the DsiRNA composition. The hairpin structure will not block Dicer activity on the DsiRNA and will not interfere with the directed destruction of the target RNA.

As used herein, a dsRNA, e.g., DsiRNA or siRNA, having a sequence "sufficiently complementary" to a target RNA or cDNA sequence (e.g., AR mRNA) means that the dsRNA has a sequence sufficient to trigger the destruction of the target RNA (where a cDNA sequence is recited, the RNA sequence corresponding to the recited cDNA sequence) by the RNAi machinery (e.g., the RISC complex) or process. The dsRNA molecule can be designed such that every residue of the antisense strand is complementary to a residue in the target molecule. Alternatively, substitutions can be made within the molecule to increase stability and/or enhance processing activity of said molecule. Substitutions can be made within the strand or can be made to residues at the ends of the strand. In certain embodiments, substitutions and/or modifications are made at specific residues within a DsiRNA agent. Such substitutions and/or modifications can include, e.g., deoxy-modifications at one or more residues of positions 1, 2 and 3 when numbering from the 3' terminal position of the sense strand of a DsiRNA agent; and introduction of 2'-O-alkyl (e.g., 2'-O-methyl) modifications at the 3' terminal residue of the antisense strand of DsiRNA agents, with such modifications also being performed at overhang positions of the 3' portion of the antisense strand and at alternating residues of the antisense strand of the DsiRNA that are included within the region of a DsiRNA agent that is processed to form an active siRNA agent. The preceding modifications are offered as exemplary, and are not intended to be limiting in any manner Further consideration of the structure of preferred DsiRNA agents, including further description of the modifications and substitutions that can be performed upon the anti-AR DsiRNA agents of the instant invention, can be found below.

As used herein, a dsRNA, e.g., DsiRNA or siRNA, having a sequence "sufficiently complementary" to a target RNA or cDNA sequence (e.g., AR mRNA) means that the dsRNA has a sequence sufficient to trigger the destruction of the target RNA (where a cDNA sequence is recited, the RNA sequence corresponding to the recited cDNA sequence) by the RNAi machinery (e.g., the RISC complex) or process. For example, a dsRNA that is "sufficiently complementary" to a target RNA or cDNA sequence to trigger the destruction of the target RNA by the RNAi machinery or process can be identified as a dsRNA that causes a detectable reduction in the level of the target RNA in an appropriate assay of dsRNA activity (e.g., an in vitro assay as described in Example 2 below), or, in further examples, a dsRNA that is sufficiently complementary to a target RNA or cDNA sequence to trigger the destruction of the target RNA by the RNAi machinery or process can be identified as a dsRNA that produces at least a 5%, at least a 10%, at least a 15%, at least a 20%, at least a 25%, at least a 30%, at least a 35%, at least a 40%, at least a 45%, at least a 50%, at least a 55%, at least a 60%, at least a 65%, at least a 70%, at least a 75%, at least a 80%, at least a 85%, at least a 90%, at least a 95%, at least a 98% or at least a 99% reduction in the level of the target RNA in an appropriate assay of dsRNA activity. In additional examples, a dsRNA that is sufficiently complementary to a target RNA or cDNA sequence to trigger the destruction of the target RNA by the RNAi machinery or process can be identified based upon assessment of the duration of a certain level of inhibitory activity with respect to the target RNA or protein levels in a cell or organism. For example, a dsRNA that is sufficiently complementary to a target RNA or cDNA sequence to trigger the destruction of the target RNA by the RNAi machinery or process can be identified as a dsRNA capable of reducing target mRNA levels by at least 20% at least 48 hours post-administration of said dsRNA to a cell or organism. Preferably, a dsRNA that is sufficiently complementary to a target RNA or cDNA sequence to trigger the destruction of the target RNA by the RNAi machinery or process is identified as a dsRNA capable of reducing target mRNA levels by at least 40% at least 72 hours post-administration of said dsRNA to a cell or organism, by at least 40% at least four, five or seven days post-administration of said dsRNA to a cell or organism, by at least 50% at least 48 hours post-administration of said dsRNA to a cell or organism, by at least 50% at least 72 hours post-administration of said dsRNA to a cell or organism, by at least 50% at least four, five or seven days post-administration of said dsRNA to a cell or organism, by at least 80% at least 48 hours post-administration of said dsRNA to a cell or organism, by at least 80% at least 72 hours post-administration of said dsRNA to a cell or organism, or by at least 80% at least four, five or seven days post-administration of said dsRNA to a cell or organism.

The dsRNA molecule can be designed such that every residue of the antisense strand is complementary to a residue in the target molecule. Alternatively, substitutions can be made within the molecule to increase stability and/or enhance processing activity of said molecule. Substitutions can be made within the strand or can be made to residues at the ends of the strand. In certain embodiments, substitutions and/or modifications are made at specific residues within a DsiRNA agent. Such substitutions and/or modifications can include, e.g., deoxy-modifications at one or more residues of positions 1, 2 and 3 when numbering from the 3' terminal position of the sense strand of a DsiRNA agent; and introduction of 2'-O-alkyl (e.g., 2'-O-methyl) modifications at the 3' terminal residue of the antisense strand of DsiRNA agents, with such modifications also being performed at overhang positions of the 3' portion of the antisense strand and at alternating residues of the antisense strand of the DsiRNA that are included within the region of a DsiRNA agent that is processed to form an active siRNA agent. The preceding modifications are offered as exemplary, and are not intended to be limiting in any manner. Further consideration of the structure of preferred DsiRNA agents, including further description of the modifications and substitutions that can be performed upon the anti-AR DsiRNA agents of the instant invention, can be found below.

Where a first sequence is referred to as "substantially complementary" with respect to a second sequence herein, the two sequences can be fully complementary, or they may form one or more, but generally not more than 4, 3 or 2 mismatched base pairs upon hybridization, while retaining the ability to hybridize under the conditions most relevant to their ultimate application. However, where two oligonucleotides are designed to form, upon hybridization, one or more single stranded overhangs, such overhangs shall not be regarded as mismatches with regard to the determination of complementarity. For example, a dsRNA comprising one oligonucleotide 21 nucleotides in length and another oligonucleotide 23 nucleotides in length, wherein the longer oligonucleotide comprises a sequence of 21 nucleotides that is fully complementary to the shorter oligonucleotide, may yet be referred to as "fully complementary" for the purposes of the invention.

The term "double-stranded RNA" or "dsRNA", as used herein, refers to a complex of ribonucleic acid molecules, having a duplex structure comprising two anti-parallel and substantially complementary, as defined above, nucleic acid strands. The two strands forming the duplex structure may be different portions of one larger RNA molecule, or they may be separate RNA molecules. Where separate RNA molecules, such dsRNA are often referred to as siRNA ("short interfering RNA") or DsiRNA ("Dicer substrate siRNAs"). Where the two strands are part of one larger molecule, and therefore are connected by an uninterrupted chain of nucleotides between the 3'-end of one strand and the 5' end of the respective other strand forming the duplex structure, the connecting RNA chain is referred to as a "hairpin loop", "short hairpin RNA" or "shRNA". Where the two strands are connected covalently by means other than an uninterrupted chain of nucleotides between the 3'-end of one strand and the 5' end of the respective other strand forming the duplex structure, the connecting structure is referred to as a "linker". The RNA strands may have the same or a different number of nucleotides. The maximum number of base pairs is the number of nucleotides in the shortest strand of the dsRNA minus any overhangs that are present in the duplex. In addition to the duplex structure, a dsRNA may comprise one or more nucleotide overhangs. In addition, as used herein, "dsRNA" may include chemical modifications to ribonucleotides, internucleoside linkages, end-groups, caps, and conjugated moieties, including substantial modifications at multiple nucleotides and including all types of modifications disclosed herein or known in the art. Any such modifications, as used in an siRNA- or DsiRNA-type molecule, are encompassed by "dsRNA" for the purposes of this specification and claims.

The phrase "duplex region" refers to the region in two complementary or substantially complementary oligonucleotides that form base pairs with one another, either by Watson-Crick base pairing or other manner that allows for a duplex between oligonucleotide strands that are complementary or substantially complementary. For example, an oligonucleotide strand having 21 nucleotide units can base pair with another oligonucleotide of 21 nucleotide units, yet only 19 bases on each strand are complementary or substantially complementary, such that the "duplex region" consists of 19 base pairs. The remaining base pairs may, for example, exist as 5' and 3' overhangs. Further, within the duplex region, 100% complementarity is not required; substantial complementarity is allowable within a duplex region. Substantial complementarity refers to complementarity between the strands such that they are capable of annealing under biological conditions. Techniques to empirically determine if two strands are capable of annealing under biological conditions are well know in the art. Alternatively, two strands can be synthesized and added together under biological conditions to determine if they anneal to one another.

Single-stranded nucleic acids that base pair over a number of bases are said to "hybridize." Hybridization is typically determined under physiological or biologically relevant conditions (e.g., intracellular: pH 7.2, 140 mM potassium ion; extracellular pH 7.4, 145 mM sodium ion). Hybridization conditions generally contain a monovalent cation and biologically acceptable buffer and may or may not contain a divalent cation, complex anions, e.g. gluconate from potassium gluconate, uncharged species such as sucrose, and inert polymers to reduce the activity of water in the sample, e.g. PEG. Such conditions include conditions under which base pairs can form.

Hybridization is measured by the temperature required to dissociate single stranded nucleic acids forming a duplex, i.e., (the melting temperature; Tm). Hybridization conditions are also conditions under which base pairs can form. Various conditions of stringency can be used to determine hybridization (see, e.g., Wahl, G. M. and S. L. Berger (1987) Methods Enzymol. 152:399; Kimmel, A. R.

(1987) Methods Enzymol. 152:507). Stringent temperature conditions will ordinarily include temperatures of at least about 30° C., more preferably of at least about 37° C., and most preferably of at least about 42° C. The hybridization temperature for hybrids anticipated to be less than 50 base pairs in length should be 5-10° C. less than the melting temperature (Tm) of the hybrid, where Tm is determined according to the following equations. For hybrids less than 18 base pairs in length, $Tm(°C.)=2(\text{\# of A+T bases})+4(\text{\# of G+C bases})$. For hybrids between 18 and 49 base pairs in length, $Tm(°C.)=81.5+16.6(\log 10[Na+])+0.41(\% G+C)-(600/N)$, where N is the number of bases in the hybrid, and [Na+] is the concentration of sodium ions in the hybridization buffer ([Na+] for 1×SSC=0.165 M). For example, a hybridization determination buffer is shown in Table 1.

TABLE 1

|  | final conc. | Vender | Cat# | Lot# | m.w./Stock | To make 50 mL solution |
|---|---|---|---|---|---|---|
| NaCl | 100 mM | Sigma | S-5150 | 41K8934 | 5M | 1 mL |
| KCl | 80 mM | Sigma | P-9541 | 70K0002 | 74.55 | 0.298 g |
| MgCl$_2$ | 8 mM | Sigma | M-1028 | 120K8933 | 1M | 0.4 mL |
| sucrose | 2% w/v | Fisher | BP220-212 | 907105 | 342.3 | 1 g |
| Tris-HCl | 16 mM | Fisher | BP1757-500 | 12419 | 1M | 0.8 mL |
| NaH$_2$PO$_4$ | 1 mM | Sigma | S-3193 | 52H-029515 | 120.0 | 0.006 g |
| EDTA | 0.02 mM | Sigma | E-7889 | 110K89271 | 0.5M | 2 µL |
| H$_2$O pH = 7.0 at 20° C. | | Sigma | W-4502 | 51K2359 adjust with HCl | | to 50 mL |

Useful variations on hybridization conditions will be readily apparent to those skilled in the art. Hybridization techniques are well known to those skilled in the art and are described, for example, in Benton and Davis (Science 196: 180, 1977); Grunstein and Hogness (Proc. Natl. Acad. Sci., USA 72:3961, 1975); Ausubel et al. (Current Protocols in Molecular Biology, Wiley Interscience, New York, 2001); Berger and Kimmel (Antisense to Molecular Cloning Techniques, 1987, Academic Press, New York); and Sambrook et al., Molecular Cloning: A Laboratory Manual, Cold Spring Harbor Laboratory Press, New York.

As used herein, "oligonucleotide strand" is a single stranded nucleic acid molecule. An oligonucleotide may comprise ribonucleotides, deoxyribonucleotides, modified nucleotides (e.g., nucleotides with 2' modifications, synthetic base analogs, etc.) or combinations thereof. Such modified oligonucleotides can be preferred over native forms because of properties such as, for example, enhanced cellular uptake and increased stability in the presence of nucleases.

As used herein, the term "ribonucleotide" encompasses natural and synthetic, unmodified and modified ribonucleotides. Modifications include changes to the sugar moiety, to the base moiety and/or to the linkages between ribonucleotides in the oligonucleotide. As used herein, the term "ribonucleotide" specifically excludes a deoxyribonucleotide, which is a nucleotide possessing a single proton group at the 2' ribose ring position.

As used herein, the term "deoxyribonucleotide" encompasses natural and synthetic, unmodified and modified deoxyribonucleotides. Modifications include changes to the sugar moiety, to the base moiety and/or to the linkages between deoxyribonucleotide in the oligonucleotide. As used herein, the term "deoxyribonucleotide" also includes a modified ribonucleotide that does not permit Dicer cleavage of a dsRNA agent, e.g., a 2'-O-methyl ribonucleotide, a phosphorothioate-modified ribonucleotide residue, etc., that does not permit Dicer cleavage to occur at a bond of such a residue.

As used herein, the term "PS-NA" refers to a phosphorothioate-modified nucleotide residue. The term "PS-NA" therefore encompasses both phosphorothioate-modified ribonucleotides ("PS-RNAs") and phosphorothioate-modified deoxyribonucleotides ("PS-DNAs").

As used herein, "Dicer" refers to an endoribonuclease in the RNase III family that cleaves a dsRNA or dsRNA-containing molecule, e.g., double-stranded RNA (dsRNA) or pre-microRNA (miRNA), into double-stranded nucleic acid fragments 19-25 nucleotides long, usually with a two-base overhang on the 3' end. With respect to the dsRNAs of the invention, the duplex formed by a dsRNA region of an agent of the invention is recognized by Dicer and is a Dicer substrate on at least one strand of the duplex. Dicer catalyzes the first step in the RNA interference pathway, which consequently results in the degradation of a target RNA. The protein sequence of human Dicer is provided at the NCBI database under accession number NP_085124, hereby incorporated by reference.

Dicer "cleavage" is determined as follows (e.g., see Collingwood et al., Oligonucleotides 18:187-200 (2008)). In a Dicer cleavage assay, RNA duplexes (100 pmol) are incubated in 20 µL of 20 mM Tris pH 8.0, 200 mM NaCl, 2.5 mM MgC12 with or without 1 unit of recombinant human Dicer (Stratagene, La Jolla, Calif.) at 37° C. for 18-24 hours. Samples are desalted using a Performa SR 96-well plate (Edge Biosystems, Gaithersburg, Md.). Electrospray-ionization liquid chromatography mass spectroscopy (ESI-LCMS) of duplex RNAs pre- and post-treatment with Dicer is done using an Oligo HTCS system (Novatia, Princeton, N.J.; Hail et al., 2004), which consists of a ThermoFinnigan TSQ7000, Xcalibur data system, ProMass data processing software and Paradigm MS4 HPLC (Michrom BioResources, Auburn, Calif.). In this assay, Dicer cleavage occurs where at least 5%, 10%, 20%, 30%, 40%, 50%, 60%, 70%, 80%, 90%, 95%, or even 100% of the Dicer substrate dsRNA, (i.e., 25-30 bp, dsRNA, preferably 26-30 by dsRNA) is cleaved to a shorter dsRNA (e.g., 19-23 by dsRNA, preferably, 2'-23 by dsRNA).

Figures 1, 7:
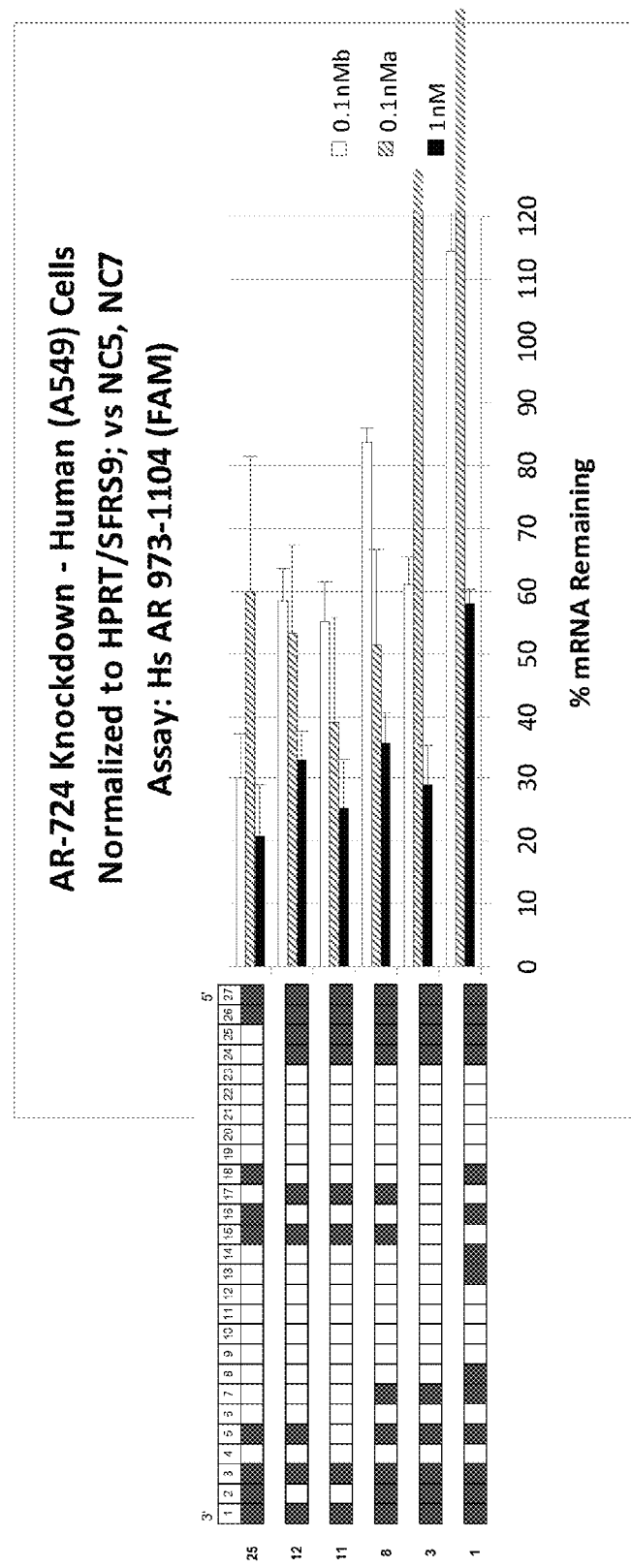
Figures 2, 7:
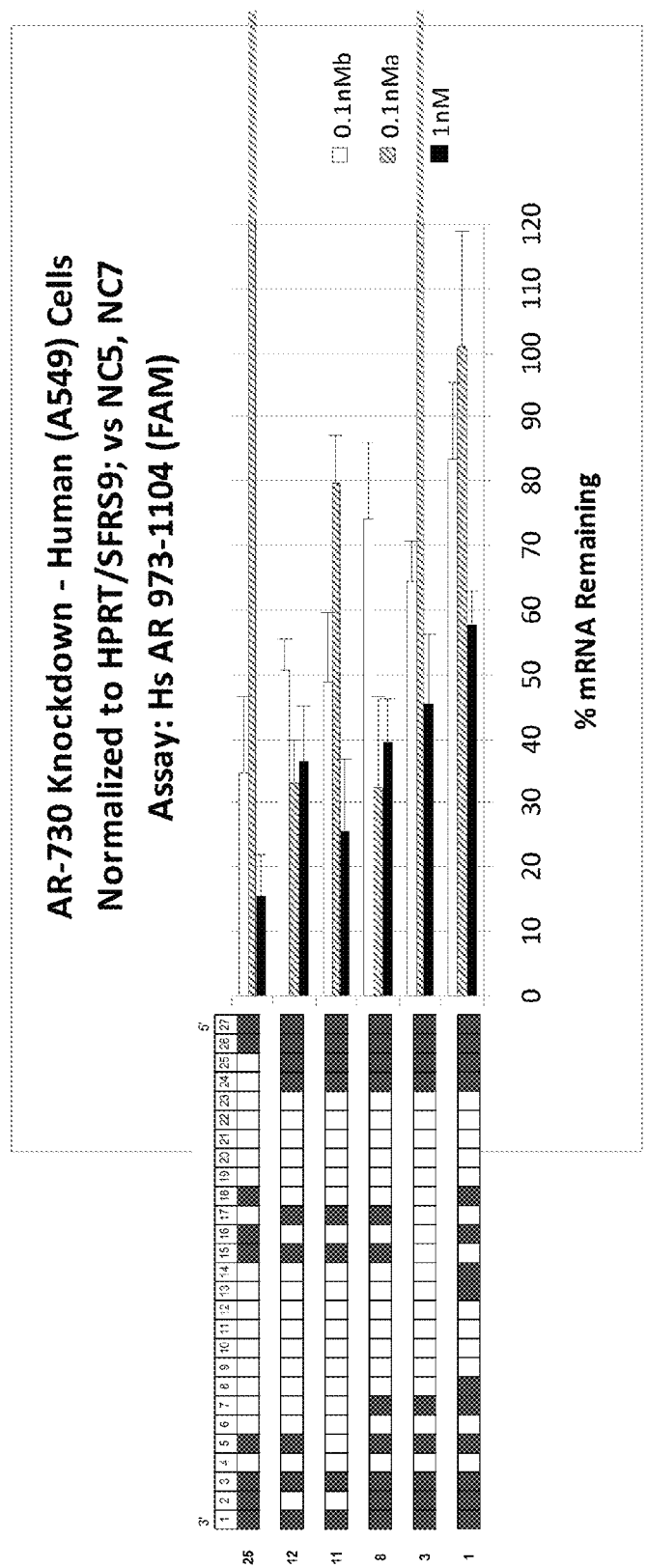
Figures 3, 7:
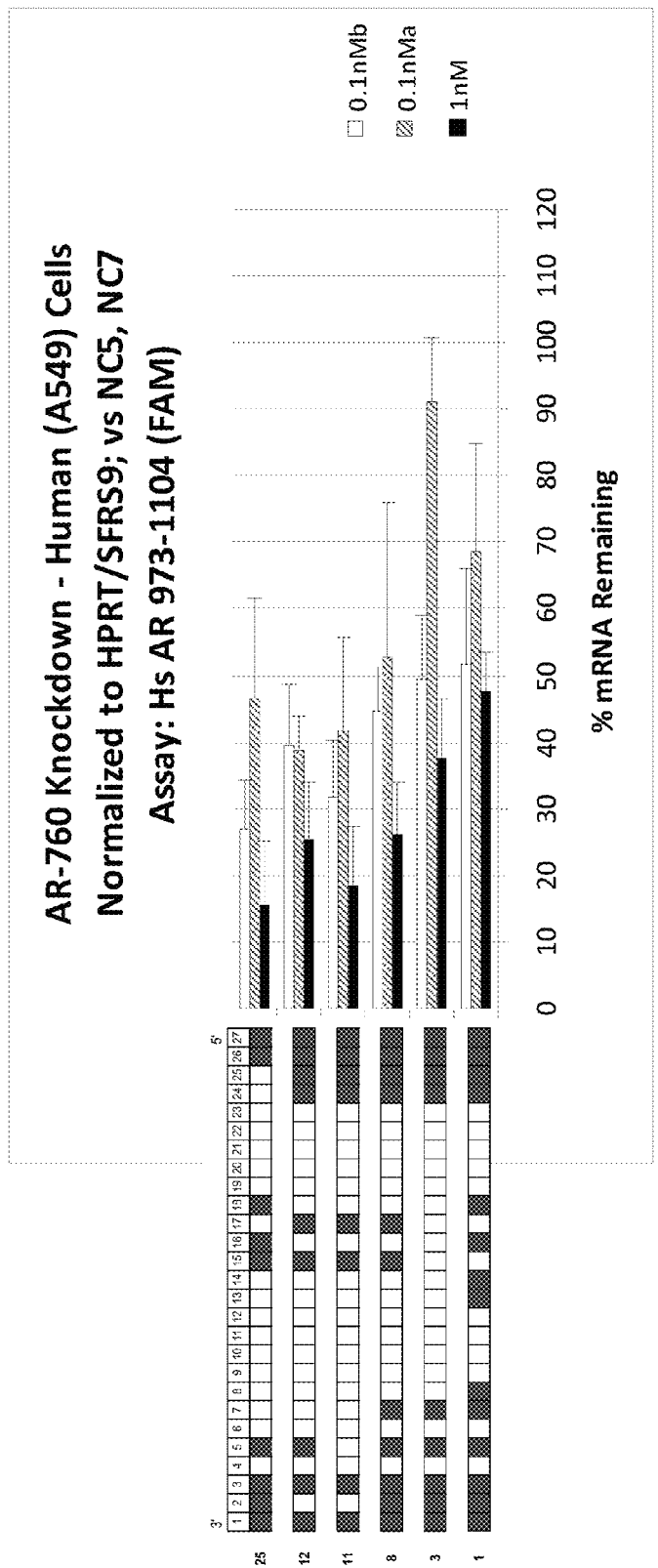
Figures 4, 7:
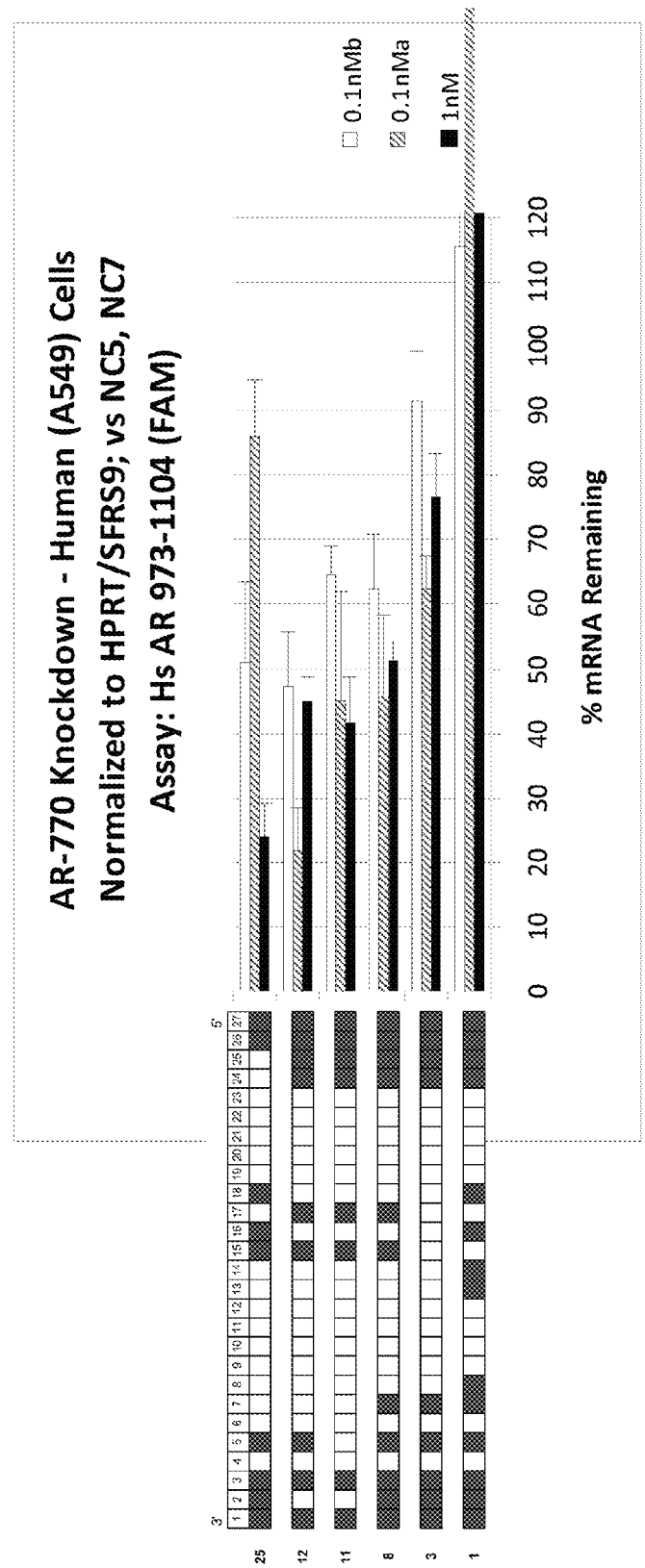

As used herein, "Dicer cleavage site" refers to the sites at which Dicer cleaves a dsRNA (e.g., the dsRNA region of a DsiRNA agent of the invention). Dicer contains two RNase III domains which typically cleave both the sense and antisense strands of a dsRNA. The average distance between the RNase III domains and the PAZ domain determines the length of the short double-stranded nucleic acid fragments it produces and this distance can vary (Macrae et al. (2006) Science 311: 195-8). As shown in FIG. 1, Dicer is projected to cleave certain double-stranded ribonucleic acids of the instant invention that possess an antisense strand having a 2 nucleotide 3' overhang at a site between the $21^{st}$ and $22^{nd}$ nucleotides removed from the 3' terminus of the antisense strand, and at a corresponding site between the $21^{st}$ and $22^{nd}$ nucleotides removed from the 5' terminus of the sense strand. The projected and/or prevalent Dicer cleavage site(s) for dsRNA molecules distinct from those depicted in FIG. 1 may be similarly identified via art-recognized methods, including those described in Macrae et al. While the Dicer cleavage events depicted in FIG. 1 generate 21 nucleotide siRNAs, it is noted that Dicer cleavage of a dsRNA (e.g., DsiRNA) can result in generation of Dicer-processed siRNA lengths of 19 to 23 nucleotides in length. Indeed, in certain embodiments, a double-stranded DNA region may be included within a dsRNA for purpose of directing prevalent Dicer excision of a typically non-preferred 19mer or 20mer siRNA, rather than a 21mer.

As used herein, "overhang" refers to unpaired nucleotides, in the context of a duplex having one or more free ends at the 5' terminus or 3' terminus of a dsRNA. In certain embodiments, the overhang is a 3' or 5' overhang on the antisense strand or sense strand. In some embodiments, the overhang is a 3' overhang having a length of between one and six nucleotides, optionally one to five, one to four, one to three, one to two, two to six, two to five, two to four, two to three, three to six, three to five, three to four, four to six, four to five, five to six nucleotides, or one, two, three, four, five or six nucleotides.

A dsRNA of the invention comprises two RNA strands that are sufficiently complementary to hybridize to form a duplex structure. One strand of the dsRNA (the antisense strand) comprises a region of complementarity that is substantially complementary, and generally fully complementary, to a target sequence, derived from the sequence of an mRNA formed during the expression of the AR target gene, the other strand (the sense strand) comprises a region which is complementary to the antisense strand, such that the two strands hybridize and form a duplex structure when combined under suitable conditions. Generally, the duplex structure is between 15 and 35, optionally between 25 and 30, between 26 and 30, between 18 and 25, between 19 and 24, or between 19 and 21 base pairs in length. Similarly, the region of complementarity to the target sequence is between 15 and 35, optionally between 18 and 30, between 25 and 30, between 19 and 24, or between 19 and 21 nucleotides in length. The dsRNA of the invention may further comprise one or more single-stranded nucleotide overhang(s). It has been identified that dsRNAs comprising duplex structures of between 15 and 35 base pairs in length can be effective in inducing RNA interference, including DsiRNAs (generally of at least 25 base pairs in length) and siRNAs (in certain embodiments, duplex structures of siRNAs are between 20 and 23, and optionally, specifically 21 base pairs (Elbashir et al., *EMBO* 20: 6877-6888)). It has also been identified that dsRNAs possessing duplexes shorter than 20 base pairs can be effective as well (e.g., 15, 16, 17, 18 or 19 base pair duplexes). In certain embodiments, the dsRNAs of the invention can comprise at least one strand of a length of 19 nucleotides or more. In certain embodiments, it can be reasonably expected that shorter dsRNAs comprising a sequence complementary to one of the sequences of Table 10 below, minus only a few nucleotides on one or both ends may be similarly effective as compared to the dsRNAs described above and in Tables 2-5 and 7-10. Hence, dsRNAs comprising a partial sequence of at least 15, 16, 17, 18, 19, 20, or more contiguous nucleotides sufficiently complementary to one of the sequences of Table 10, and differing in their ability to inhibit the expression of the AR target gene in an assay as described herein by not more than 5, 10, 15, 20, 25, or 30% inhibition from a dsRNA comprising the full sequence, are contemplated by the invention. In one embodiment, at least one end of the dsRNA has a single-stranded nucleotide overhang of 1 to 5, optionally 1 to 4, in certain embodiments, 1 or 2 nucleotides. Certain dsRNA structures having at least one nucleotide overhang possess superior inhibitory properties as compared to counterparts possessing base-paired blunt ends at both ends of the dsRNA molecule.

As used herein, the term "RNA processing" refers to processing activities performed by components of the siRNA, miRNA or RNase H pathways (e.g., Drosha, Dicer, Argonaute2 or other RISC endoribonucleases, and RNaseH), which are described in greater detail below (see "RNA Processing" section below). The term is explicitly distinguished from the post-transcriptional processes of 5' capping of RNA and degradation of RNA via non-RISC- or non-RNase H-mediated processes. Such "degradation" of an RNA can take several forms, e.g. deadenylation (removal of a 3' poly(A) tail), and/or nuclease digestion of part or all of the body of the RNA by one or more of several endo- or exo-nucleases (e.g., RNase III, RNase P, RNase T1, RNase A (1, 2, 3, 4/5), oligonucleotidase, etc.).

By "homologous sequence" is meant, a nucleotide sequence that is shared by one or more polynucleotide sequences, such as genes, gene transcripts and/or non-coding polynucleotides. For example, a homologous sequence can be a nucleotide sequence that is shared by two or more genes encoding related but different proteins, such as different members of a gene family, different protein epitopes, different protein isoforms or completely divergent genes, such as a cytokine and its corresponding receptors. A homologous sequence can be a nucleotide sequence that is shared by two or more non-coding polynucleotides, such as noncoding DNA or RNA, regulatory sequences, introns, and sites of transcriptional control or regulation. Homologous sequences can also include conserved sequence regions shared by more than one polynucleotide sequence. Homology does not need to be perfect homology (e.g., 100%), as partially homologous sequences are also contemplated by the instant invention (e.g., 99%, 98%, 97%, 96%, 95%, 94%, 93%, 92%, 91%, 90%, 89%, 88%, 87%, 86%, 85%, 84%, 83%, 82%, 81%, 80% etc.). Indeed, design and use of the DsiRNA agents of the instant invention contemplates the possibility of using such DsiRNA agents not only against target RNAs of AR possessing perfect complementarity with the presently described DsiRNA agents, but also against target AR RNAs possessing sequences that are, e.g., only 99%, 98%, 97%, 96%, 95%, 94%, 93%, 92%, 91%, 90%, 89%, 88%, 87%, 86%, 85%, 84%, 83%, 82%, 81%, 80% etc. complementary to said DsiRNA agents. Similarly, it is contemplated that the presently described DsiRNA agents of the instant invention might be readily altered by the skilled artisan to enhance the extent of complementarity between said DsiRNA agents and a target AR RNA, e.g., of a specific allelic variant of AR (e.g., an allele of enhanced therapeutic interest). Indeed, DsiRNA agent sequences with insertions, deletions, and single point mutations relative to the target AR sequence can also be effective for inhibition. Alternatively, DsiRNA agent sequences with nucleotide analog substitutions or insertions can be effective for inhibition.

Sequence identity may be determined by sequence comparison and alignment algorithms known in the art. To determine the percent identity of two nucleic acid sequences (or of two amino acid sequences), the sequences are aligned for comparison purposes (e.g., gaps can be introduced in the first sequence or second sequence for optimal alignment). The nucleotides (or amino acid residues) at corresponding nucleotide (or amino acid) positions are then compared. When a position in the first sequence is occupied by the same residue as the corresponding position in the second sequence, then the molecules are identical at that position. The percent identity between the two sequences is a function of the number of identical positions shared by the sequences (i.e., % homology=# of identical positions/total # of positions.times.100), optionally penalizing the score for the number of gaps introduced and/or length of gaps introduced.

The comparison of sequences and determination of percent identity between two sequences can be accomplished using a mathematical algorithm. In one embodiment, the alignment generated over a certain portion of the sequence aligned having sufficient identity but not over portions having low degree of identity (i.e., a local alignment). A preferred, non-limiting example of a local alignment algorithm utilized for the comparison of sequences is the algorithm of Karlin and Altschul (1990) Proc. Natl. Acad. Sci. USA 87:2264-68, modified as in Karlin and Altschul (1993) Proc. Natl. Acad. Sci. USA 90:5873-77. Such an algorithm is incorporated into the BLAST programs (version 2.0) of Altschul, et al. (1990) J. Mol. Biol. 215:403-10.

In another embodiment, a gapped alignment the alignment is optimized is formed by introducing appropriate gaps, and percent identity is determined over the length of the aligned sequences (i.e., a gapped alignment). To obtain gapped alignments for comparison purposes, Gapped BLAST can be utilized as described in Altschul et al., (1997) Nucleic Acids Res. 25(17):3389-3402. In another embodiment, a global alignment the alignment is optimizedis formed by introducing appropriate gaps, and percent identity is determined over the entire length of the sequences aligned. (i.e., a global alignment). A preferred, non-limiting example of a mathematical algorithm utilized for the global comparison of sequences is the algorithm of Myers and Miller, CABIOS (1989). Such an algorithm is incorporated into the ALIGN program (version 2.0) which is part of the GCG sequence alignment software package. When utilizing the ALIGN program for comparing amino acid sequences, a PAM120 weight residue table, a gap length penalty of 12, and a gap penalty of 4 can be used.

Greater than 80% sequence identity, e.g., 80%, 81%, 82%, 83%, 84%, 85%, 86%, 87%, 88%, 89%, 90%, 91%, 92%, 93%, 94%, 95%, 96%, 97%, 98%, 99% or even 100% sequence identity, between the DsiRNA antisense strand and the portion of the AR RNA sequence is preferred. Alternatively, the DsiRNA may be defined functionally as a nucleotide sequence (or oligonucleotide sequence) that is capable of hybridizing with a portion of the AR RNA (e.g., 400 mM NaCl, 40 mM PIPES pH 6.4, 1 mM EDTA, 50° C. or 70° C. hybridization for 12-16 hours; followed by washing). Additional preferred hybridization conditions include hybridization at 70° C. in 1×SSC or 50° C. in 1×SSC, 50% formamide followed by washing at 70° C. in 0.3×SSC or hybridization at 70° C. in 4×SSC or 50° C. in 4×SSC, 50% formamide followed by washing at 67° C. in 1×SSC. The hybridization temperature for hybrids anticipated to be less than 50 base pairs in length should be 5-10° C. less than the melting temperature (Tm) of the hybrid, where Tm is determined according to the following equations. For hybrids less than 18 base pairs in length, Tm(° C.)=2(# of A+T bases)+4(# of G+C bases). For hybrids between 18 and 49 base pairs in length, Tm(° C.)=81.5+16.6(log 10[Na+])+0.41 (% G+C)−(600/N), where N is the number of bases in the hybrid, and [Na+] is the concentration of sodium ions in the hybridization buffer ([Na+] for 1×SSC=0.165 M). Additional examples of stringency conditions for polynucleotide hybridization are provided in Sambrook, J., E. F. Fritsch, and T. Maniatis, 1989, Molecular Cloning: A Laboratory Manual, Cold Spring Harbor Laboratory Press, Cold Spring Harbor, N.Y., chapters 9 and 11, and Current Protocols in Molecular Biology, 1995, F. M. Ausubel et al., eds., John Wiley & Sons, Inc., sections 2.10 and 6.3-6.4. The length of the identical nucleotide sequences may be at least 10, 12, 15, 17, 20, 22, 25, 27 or 30 bases.

By "conserved sequence region" is meant, a nucleotide sequence of one or more regions in a polynucleotide does not vary significantly between generations or from one biological system, subject, or organism to another biological system, subject, or organism. The polynucleotide can include both coding and non-coding DNA and RNA.

By "sense region" is meant a nucleotide sequence of a DsiRNA molecule having complementarity to an antisense region of the DsiRNA molecule. In addition, the sense region of a DsiRNA molecule can comprise a nucleic acid sequence having homology with a target nucleic acid sequence.

By "antisense region" is meant a nucleotide sequence of a DsiRNA molecule having complementarity to a target nucleic acid sequence. In addition, the antisense region of a DsiRNA molecule comprises a nucleic acid sequence having complementarity to a sense region of the DsiRNA molecule.

As used herein, "antisense strand" refers to a single stranded nucleic acid molecule which has a sequence complementary to that of a target RNA. When the antisense strand contains modified nucleotides with base analogs, it is not necessarily complementary over its entire length, but must at least hybridize with a target RNA.

As used herein, "sense strand" refers to a single stranded nucleic acid molecule which has a sequence complementary to that of an antisense strand. When the antisense strand contains modified nucleotides with base analogs, the sense strand need not be complementary over the entire length of the antisense strand, but must at least duplex with the antisense strand.

As used herein, "guide strand" refers to a single stranded nucleic acid molecule of a dsRNA or dsRNA-containing molecule, which has a sequence sufficiently complementary to that of a target RNA to result in RNA interference. After cleavage of the dsRNA or dsRNA-containing molecule by Dicer, a fragment of the guide strand remains associated with RISC, binds a target RNA as a component of the RISC complex, and promotes cleavage of a target RNA by RISC. As used herein, the guide strand does not necessarily refer to a continuous single stranded nucleic acid and may comprise a discontinuity, preferably at a site that is cleaved by Dicer. A guide strand is an antisense strand.

As used herein, "passenger strand" refers to an oligonucleotide strand of a dsRNA or dsRNA-containing molecule, which has a sequence that is complementary to that of the guide strand. As used herein, the passenger strand does not necessarily refer to a continuous single stranded nucleic acid and may comprise a discontinuity, preferably at a site that is cleaved by Dicer. A passenger strand is a sense strand.

By "target nucleic acid" is meant a nucleic acid sequence whose expression, level or activity is to be modulated. The target nucleic acid can be DNA or RNA. For agents that target AR, in certain embodiments target nucleic acid is AR RNA. AR RNA target sites can also interchangeably be referenced by corresponding cDNA sequences. Levels of AR may also be targeted via targeting of upstream effectors of AR, or the effects of modulated or misregulated AR may also be modulated by targeting of molecules downstream of AR in the AR signalling pathway.

By "complementarity" is meant that a nucleic acid can form hydrogen bond(s) with another nucleic acid sequence by either traditional Watson-Crick or other non-traditional types. In reference to the nucleic molecules of the present invention, the binding free energy for a nucleic acid molecule with its complementary sequence is sufficient to allow the relevant function of the nucleic acid to proceed, e.g., RNAi activity. Determination of binding free energies for nucleic acid molecules is well known in the art (see, e.g., Turner et al., 1987, CSH Symp. Quant. Biol. LII pp. 123-133; Frier et al., 1986, Proc. Nat. Acad. Sci. USA 83:9373-9377; Turner et al., 1987, J. Am. Chem. Soc. 109:3783-3785). A percent complementarity indicates the percentage of contiguous residues in a nucleic acid molecule that can form hydrogen bonds (e.g., Watson-Crick base pairing) with a second nucleic acid sequence (e.g., 5, 6, 7, 8, 9, or 10 nucleotides out of a total of 10 nucleotides in the first oligonucleotide being based paired to a second nucleic acid sequence having 10 nucleotides represents 50%, 60%, 70%, 80%, 90%, and 100% complementary respectively). "Perfectly complementary" means that all the contiguous residues of a nucleic acid sequence will hydrogen bond with the same number of contiguous residues in a second nucleic acid sequence. In one embodiment, a DsiRNA molecule of the invention comprises 19 to 30 (e.g., 19, 20, 21, 22, 23, 24, 25, 26, 27, 28, 29, or 30 or more) nucleotides that are complementary to one or more target nucleic acid molecules or a portion thereof.

In one embodiment, DsiRNA molecules of the invention that down regulate or reduce AR gene expression are used for treating, preventing or reducing AR-related diseases or disorders (e.g., cancer) in a subject or organism.

In one embodiment of the present invention, each sequence of a DsiRNA molecule of the invention is independently 25 to 35 nucleotides in length, in specific embodiments 25, 26, 27, 28, 29, 30, 31, 32, 33, 34 or 35 nucleotides in length. In another embodiment, the DsiRNA duplexes of the invention independently comprise 25 to 30 base pairs (e.g., 25, 26, 27, 28, 29, or 30). In another embodiment, one or more strands of the DsiRNA molecule of the invention independently comprises 19 to 35 nucleotides (e.g., 19, 20, 21, 22, 23, 24, 25, 26, 27, 28, 29, 30, 31, 32, 33, 34 or 35) that are complementary to a target (AR) nucleic acid molecule. In certain embodiments, a DsiRNA molecule of the invention possesses a length of duplexed nucleotides between 25 and 34 nucleotides in length (e.g., 25, 26, 27, 28, 29, 30, 31, 32, 33 or 34 nucleotides in length; optionally, all such nucleotides base pair with cognate nucleotides of the opposite strand). (Exemplary DsiRNA molecules of the invention are shown in FIG. 1, and below.

As used herein "cell" is used in its usual biological sense, and does not refer to an entire multicellular organism, e.g., specifically does not refer to a human. The cell can be present in an organism, e.g., birds, plants and mammals such as humans, cows, sheep, apes, monkeys, swine, dogs, and cats. The cell can be prokaryotic (e.g., bacterial cell) or eukaryotic (e.g., mammalian or plant cell). The cell can be of somatic or germ line origin, totipotent or pluripotent, dividing or non-dividing. The cell can also be derived from or can comprise a gamete or embryo, a stem cell, or a fully differentiated cell. Within certain aspects, the term "cell" refers specifically to mammalian cells, such as human cells, that contain one or more isolated dsRNA molecules of the present disclosure. In particular aspects, a cell processes dsRNAs or dsRNA-containing molecules resulting in RNA intereference of target nucleic acids, and contains proteins and protein complexes required for RNAi, e.g., Dicer and RISC.

In certain embodiments, dsRNAs of the invention are Dicer substrate siRNAs ("DsiRNAs"). DsiRNAs can possess certain advantages as compared to inhibitory nucleic acids that are not dicer substrates ("non-DsiRNAs"). Such advantages include, but are not limited to, enhanced duration of effect of a DsiRNA relative to a non-DsiRNA, as well as enhanced inhibitory activity of a DsiRNA as compared to a non-DsiRNA (e.g., a 19-23mer siRNA) when each inhibitory nucleic acid is suitably formulated and assessed for inhibitory activity in a mammalian cell at the same concentration (in this latter scenario, the DsiRNA would be identified as more potent than the non-DsiRNA). Detection of the enhanced potency of a DsiRNA relative to a non-DsiRNA is often most readily achieved at a formulated concentration (e.g., transfection concentration of the dsRNA) that results in the DsiRNA eliciting approximately 30-70% knockdown activity upon a target RNA (e.g., a mRNA). For active DsiRNAs, such levels of knockdown activity are most often achieved at in vitro mammalian cell DsiRNA transfection concentrations of 1 nM or less of as suitably formulated, and in certain instances are observed at DsiRNA transfection concentrations of 200 pM or less, 100 pM or less, 50 pM or less, 20 pM or less, 10 pM or less, 5 pM or less, or even 1 pM or less. Indeed, due to the variability among DsiRNAs of the precise concentration at which 30-70% knockdown of a target RNA is observed, construction of an IC50 curve via assessment of the inhibitory activity of DsiRNAs and non-DsiRNAs across a range of effective concentrations is a preferred method for detecting the enhanced potency of a DsiRNA relative to a non-DsiRNA inhibitory agent.

In certain embodiments, a DsiRNA (in a state as initially formed, prior to dicer cleavage) is more potent at reducing AR target gene expression in a mammalian cell than a 19, 20, 21, 22 or 23 base pair sequence that is contained within it. In certain such embodiments, a DsiRNA prior to dicer cleavage is more potent than a 19-21mer contained within it. Optionally, a DsiRNA prior to dicer cleavage is more potent than a 19 base pair duplex contained within it that is synthesized with symmetric dTdT overhangs (thereby forming a siRNA possessing 21 nucleotide strand lengths having dTdT overhangs). In certain embodiments, the DsiRNA is more potent than a 19-23mer siRNA (e.g., a 19 base pair duplex with dTdT overhangs) that targets at least 15 nucleotides of the 21 nucleotide target sequence that is recited for a DsiRNA of the invention (without wishing to be bound by theory, the identity of a such a target site for a DsiRNA is identified via identification of the Ago2 cleavage site for the DsiRNA; once the Ago2 cleavage site of a DsiRNA is determined for a DsiRNA, identification of the Ago2 cleavage site for any other inhibitory dsRNA can be performed and these Ago2 cleavage sites can be aligned, thereby determining the alignment of projected target nucleotide sequences for multiple dsRNAs). In certain related embodiments, the DsiRNA is more potent than a 19-23mer siRNA that targets at least 20 nucleotides of the 21 nucleotide target sequence that is recited for a DsiRNA of the invention. Optionally, the DsiRNA is more potent than a 19-23mer siRNA that targets the same 21 nucleotide target sequence that is recited for a DsiRNA of the invention. In certain embodiments, the DsiRNA is more potent than any 21mer siRNA that targets the same 21 nucleotide target sequence that is recited for a DsiRNA of the invention. Optionally, the DsiRNA is more potent than any 21 or 22mer siRNA that targets the same 21 nucleotide target sequence that is recited for a DsiRNA of the invention. In certain embodiments, the DsiRNA is more potent than any 21, 22 or 23mer siRNA that targets the same 21 nucleotide target sequence that is recited for a DsiRNA of the invention. As noted above, such potency assessments are most effectively performed upon dsRNAs that are suitably formulated (e.g., formulated with an appropriate transfection reagent) at a concentration of 1 nM or less. Optionally, an IC50 assessment is performed to evaluate activity across a range of effective inhibitory concentrations, thereby allowing for robust comparison of the relative potencies of dsRNAs so assayed.

The dsRNA molecules of the invention are added directly, or can be complexed with lipids (e.g., cationic lipids), packaged within liposomes, or otherwise delivered to target cells or tissues. The nucleic acid or nucleic acid complexes can be locally administered to relevant tissues ex vivo, or in vivo through direct dermal application, transdermal application, or injection, with or without their incorporation in biopolymers. In particular embodiments, the nucleic acid molecules of the invention comprise sequences shown in FIG. 1, and the below exemplary structures. Examples of such nucleic acid molecules consist essentially of sequences defined in these figures and exemplary structures. Furthermore, where such agents are modified in accordance with the below description of modification patterning of DsiRNA agents, chemically modified forms of constructs described in FIG. 1, and the below exemplary structures can be used in all uses described for the DsiRNA agents of FIG. 1, and the below exemplary structures.

In another aspect, the invention provides mammalian cells containing one or more DsiRNA molecules of this invention. The one or more DsiRNA molecules can independently be targeted to the same or different sites.

By "RNA" is meant a molecule comprising at least one, and preferably at least 4, 8 and 12 ribonucleotide residues. The at least 4, 8 or 12 RNA residues may be contiguous. By "ribonucleotide" is meant a nucleotide with a hydroxyl group at the 2' position of a β-D-ribofuranose moiety. The terms include double-stranded RNA, single-stranded RNA, isolated RNA such as partially purified RNA, essentially pure RNA, synthetic RNA, recombinantly produced RNA, as well as altered RNA that differs from naturally occurring RNA by the addition, deletion, substitution and/or alteration of one or more nucleotides. Such alterations can include addition of non-nucleotide material, such as to the end(s) of the DsiRNA or internally, for example at one or more nucleotides of the RNA. Nucleotides in the RNA molecules of the instant invention can also comprise non-standard nucleotides, such as non-naturally occurring nucleotides or chemically synthesized nucleotides or deoxynucleotides. These altered RNAs can be referred to as analogs or analogs of naturally-occurring RNA.

By "subject" is meant an organism, which is a donor or recipient of explanted cells or the cells themselves. "Subject" also refers to an organism to which the DsiRNA agents of the invention can be administered. A subject can be a mammal or mammalian cells, including a human or human cells.

The phrase "pharmaceutically acceptable carrier" refers to a carrier for the administration of a therapeutic agent. Exemplary carriers include saline, buffered saline, dextrose, water, glycerol, ethanol, and combinations thereof. For drugs administered orally, pharmaceutically acceptable carriers include, but are not limited to pharmaceutically acceptable excipients such as inert diluents, disintegrating agents, binding agents, lubricating agents, sweetening agents, flavoring agents, coloring agents and preservatives. Suitable inert diluents include sodium and calcium carbonate, sodium and calcium phosphate, and lactose, while corn starch and alginic acid are suitable disintegrating agents. Binding agents may include starch and gelatin, while the lubricating agent, if present, will generally be magnesium stearate, stearic acid or talc. If desired, the tablets may be coated with a material such as glyceryl monostearate or glyceryl distearate, to delay absorption in the gastrointestinal tract. The pharmaceutically acceptable carrier of the disclosed dsRNA compositions may be micellar structures, such as a liposomes, capsids, capsoids, polymeric nanocapsules, or polymeric microcapsules.

Polymeric nanocapsules or microcapsules facilitate transport and release of the encapsulated or bound dsRNA into the cell. They include polymeric and monomeric materials, especially including polybutylcyanoacrylate. A summary of materials and fabrication methods has been published (see Kreuter, 1991). The polymeric materials which are formed from monomeric and/or oligomeric precursors in the polymerization/nanoparticle generation step, are per se known from the prior art, as are the molecular weights and molecular weight distribution of the polymeric material which a person skilled in the field of manufacturing nanoparticles may suitably select in accordance with the usual skill.

Various methodologies of the instant invention include step that involves comparing a value, level, feature, characteristic, property, etc. to a "suitable control", referred to interchangeably herein as an "appropriate control". A "suitable control" or "appropriate control" is a control or standard familiar to one of ordinary skill in the art useful for comparison purposes. In one embodiment, a "suitable control" or "appropriate control" is a value, level, feature, characteristic, property, etc. determined prior to performing an RNAi methodology, as described herein. For example, a transcription rate, mRNA level, translation rate, protein level, biological activity, cellular characteristic or property, genotype, phenotype, etc. can be determined prior to introducing an RNA silencing agent (e.g., DsiRNA) of the invention into a cell or organism. In another embodiment, a "suitable control" or "appropriate control" is a value, level, feature, characteristic, property, etc. determined in a cell or organism, e.g., a control or normal cell or organism, exhibiting, for example, normal traits. In yet another embodiment, a "suitable control" or "appropriate control" is a predefined value, level, feature, characteristic, property, etc.

The term "in vitro" has its art recognized meaning, e.g., involving purified reagents or extracts, e.g., cell extracts. The term "in vivo" also has its art recognized meaning, e.g., involving living cells, e.g., immortalized cells, primary cells, cell lines, and/or cells in an organism.

"Treatment", or "treating" as used herein, is defined as the application or administration of a therapeutic agent (e.g., a DsiRNA agent or a vector or transgene encoding same) to a patient, or application or administration of a therapeutic agent to an isolated tissue or cell line from a patient, who has a disorder with the purpose to cure, heal, alleviate, relieve, alter, remedy, ameliorate, improve or affect the disease or disorder, or symptoms of the disease or disorder. The term "treatment" or "treating" is also used herein in the context of administering agents prophylactically. The term "effective dose" or "effective dosage" is defined as an amount sufficient to achieve or at least partially achieve the desired effect. The term "therapeutically effective dose" is defined as an amount sufficient to cure or at least partially arrest the disease and its complications in a patient already suffering from the disease. The term "patient" includes human and other mammalian subjects that receive either prophylactic or therapeutic treatment.

Structures of Anti-AR DsiRNA Agents

In certain embodiments, the anti-AR DsiRNA agents of the invention can have the following structures:

In one such embodiment, the DsiRNA comprises:

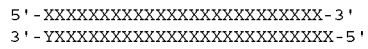

wherein "X"=RNA and "Y" is an overhang domain comprised of 1-4 RNA monomers that are optionally 2'-O-methyl RNA monomers. In a related embodiment, the DsiRNA comprises:

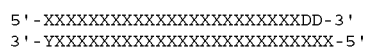

wherein "X"=RNA, "Y" is an overhang domain comprised of 1-4 RNA monomers that are optionally 2'-O-methyl RNA monomers, and "D"=DNA. In one embodiment, the top strand is the sense strand, and the bottom strand is the antisense strand. Alternatively, the bottom strand is the sense strand and the top strand is the antisense strand.

DsiRNAs of the invention can carry a broad range of modification patterns (e.g., 2'-O-methyl RNA patterns, e.g., within extended DsiRNA agents). Certain modification patterns of the second strand of DsiRNAs of the invention are presented below.

In one embodiment, the DsiRNA comprises:

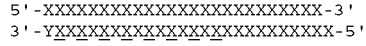

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

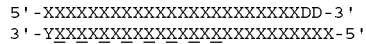

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers, and "D"=DNA. The top strand is the sense strand, and the bottom strand is the antisense strand.

In another such embodiment, the DsiRNA comprises:

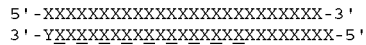

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand.

In another such embodiment, the DsiRNA comprises:

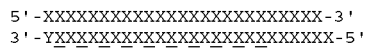

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

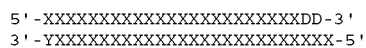

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand.

In further embodiments, the DsiRNA comprises:

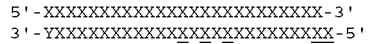

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

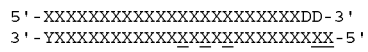

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In one related embodiment, the DsiRNA comprises:

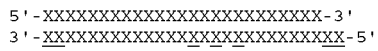

wherein "X"=RNA and "X"=2'-O-methyl RNA. In a further related embodiment, the DsiRNA comprises:

wherein "X"=RNA, "X"=2'-O-methyl RNA, and "D"=DNA. The top strand is the sense strand, and the bottom strand is the antisense strand.

In additional embodiments, the DsiRNA comprises:

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

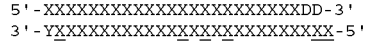

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. The top strand is the sense strand, and the bottom strand is the antisense strand. In another related embodiment, the DsiRNA comprises:

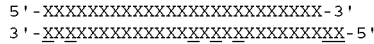

wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'
3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand.

In other embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

```
5'-XXXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In one related embodiment, the DsiRNA comprises:

```
5'-XXXXXXXXXXXXXXXXXXXXXXXXX-3'
3'-XXXXXXXXXXXXXXXXXXXXXXXXX-5'
``` wherein "X"=RNA and "X"=2'-O-methyl RNA. The top strand is the sense strand, and the bottom strand is the antisense strand. In another related embodiment, the DsiRNA comprises:

```
5'-XXXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand.

In further embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

```
5'-XXXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In one related embodiment, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'
3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand.

In additional embodiments, the DsiRNA comprises:

```
5'-XXXXXXXXXXXXXXXXXXXXXXXXX-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

```
5'-XXXXXXXXXXXXXXXXXXXXXXXXDD-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'
3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand.

In other embodiments, the DsiRNA comprises:

```
5'-XXXXXXXXXXXXXXXXXXXXXXXXX-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXDD-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand.

In additional embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

```
5'-XXXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA.

The top strand is the sense strand, and the bottom strand is the antisense strand.

In further embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

```
5'-XXXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand.

In additional embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'
3'-XXXX̲XX̲XXXXXX̲XXXX̲XXXXXXXXXXX-5'
``` wherein "X"=RNA, "X̲"=2'-O-methyl RNA, and "D"=DNA. The top strand is the sense strand, and the bottom strand is the antisense strand.

In other embodiments, the DsiRNA comprises:

```
5'-XXXXXXXXXXXXXXXXXXXXXXXXX-3'
3'-YXX̲XX̲XXXXXXXXXXXX̲XXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

```
5'-XXXXXXXXXXXXXXXXXXXXXXXXDD-3'
3'-YXX̲XX̲XXXXXXXXXXXX̲XXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXX̲XXX̲XXXXXXXXXXXXX̲XXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'
3'-XXXXX̲XXXXXXXXXXXXX̲XXXXXXXX-5'
``` wherein "X"=RNA, "X̲"=2'-O-methyl RNA, and "D"=DNA. The top strand is the sense strand, and the bottom strand is the antisense strand.

In further embodiments, the DsiRNA comprises:

```
5'-XXXXXXXXXXXXXXXXXXXXXXXXX-3'
3'-YXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXDD-3'
3'-YXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'
3'-XXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand.

In additional embodiments, the DsiRNA comprises:

```
5'-XXXXXXXXXXXXXXXXXXXXXXXXX-3'
3'-YXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXDD-3'
3'-YXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'
3'-XXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand.

In further embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand.

In other embodiments, the DsiRNA comprises:

```
5'-XXXXXXXXXXXXXXXXXXXXXXXXXXX-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In another related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXXXX-3'
3'-XXXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand.

In further embodiments, the DsiRNA comprises:

```
5'-XXXXXXXXXXXXXXXXXXXXXXXXX-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand.

In additional embodiments, the DsiRNA comprises:

```
5'-XXXXXXXXXXXXXXXXXXXXXXXXX-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand.

In further embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand.

In additional embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand.

In further embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand.

In additional embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

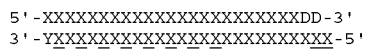

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

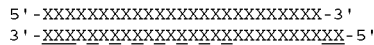

wherein "X"=RNA and "X̲"=2'-O-methyl RNA. The top strand is the sense strand, and the bottom strand is the antisense strand. In a further related embodiment, the DsiRNA comprises:

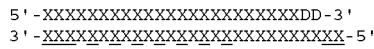

wherein "X"=RNA, "X̲"=2'-O-methyl RNA, and "D"=DNA. The top strand is the sense strand, and the bottom strand is the antisense strand.

In further embodiments, the DsiRNA comprises:

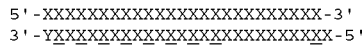

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

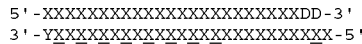

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

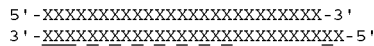

wherein "X"=RNA and "X̲"=2'-O-methyl RNA. The top strand is the sense strand, and the bottom strand is the antisense strand. In a further related embodiment, the DsiRNA comprises:

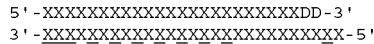

wherein "X"=RNA, "X̲"=2'-O-methyl RNA, and "D"=DNA. The top strand is the sense strand, and the bottom strand is the antisense strand.

In additional embodiments, the DsiRNA comprises:

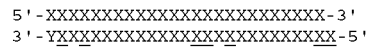

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

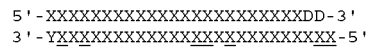

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

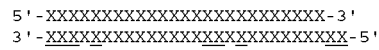

wherein "X"=RNA and "X̲"=2'-O-methyl RNA. The top strand is the sense strand, and the bottom strand is the antisense strand. In a further related embodiment, the DsiRNA comprises:

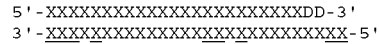

wherein "X"=RNA, "X̲"=2'-O-methyl RNA, and "D"=DNA. The top strand is the sense strand, and the bottom strand is the antisense strand.

The above modification patterns can also be incorporated into, e.g., the extended DsiRNA structures and mismatch and/or frayed DsiRNA structures described below.

In another embodiment, the DsiRNA comprises strands having equal lengths possessing 1-3 mismatched residues that serve to orient Dicer cleavage (specifically, one or more of positions 1, 2 or 3 on the first strand of the DsiRNA, when numbering from the 3'-terminal residue, are mismatched with corresponding residues of the 5'-terminal region on the second strand when first and second strands are annealed to one another). An exemplary 27mer DsiRNA agent with two terminal mismatched residues is shown:

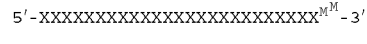

wherein "X"=RNA, "M"=Nucleic acid residues (RNA, DNA or non-natural or modified nucleic acids) that do not base pair (hydrogen bond) with corresponding "M" residues of otherwise complementary strand when strands are annealed. Any of the residues of such agents can optionally be 2'-O-methyl RNA monomers—alternating positioning of 2'-O-methyl RNA monomers that commences from the 3'-terminal residue of the bottom (second) strand, as shown for above asymmetric agents, can also be used in the above "blunt/fray" DsiRNA agent. In one embodiment, the top strand is the sense strand, and the bottom strand is the antisense strand. Alternatively, the bottom strand is the sense strand and the top strand is the antisense strand.

In certain additional embodiments, the present invention provides compositions for RNA interference (RNAi) that possess one or more base paired deoxyribonucleotides within a region of a double stranded ribonucleic acid (dsRNA) that is positioned 3' of a projected sense strand Dicer cleavage site and correspondingly 5' of a projected antisense strand Dicer cleavage site. The compositions of the invention comprise a dsRNA which is a precursor molecule, i.e., the dsRNA of the present invention is processed in vivo to produce an active small interfering nucleic acid (siRNA). The dsRNA is processed by Dicer to an active siRNA which is incorporated into RISC.

In certain embodiments, the DsiRNA agents of the invention can have the following exemplary structures (noting that any of the following exemplary structures can be combined, e.g., with the bottom strand modification patterns of the above-described structures—in one specific example, the bottom strand modification pattern shown in any of the above structures is applied to the 27 most 3' residues of the bottom strand of any of the following structures; in another specific example, the bottom strand modification pattern shown in any of the above structures upon the 23 most 3' residues of the bottom strand is applied to the 23 most 3' residues of the bottom strand of any of the following structures):

In one such embodiment, the DsiRNA comprises the following (an exemplary "right-extended", "DNA extended" DsiRNA):

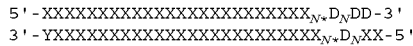

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In a related embodiment, the DsiRNA comprises:

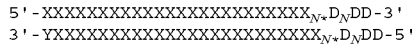

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In an additional embodiment, the DsiRNA comprises:

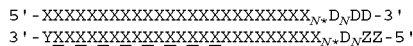

wherein "X"=RNA, "$\underline{X}$"=2'-O-methyl RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

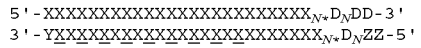

wherein "X"=RNA, "$\underline{X}$"=2'-O-methyl RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

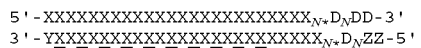

wherein "X"=RNA, "$\underline{X}$"=2'-O-methyl RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another embodiment, the DsiRNA comprises:

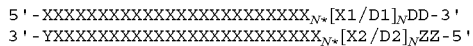

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, "Z"=DNA or RNA, and "N"=1 to 50 or more, but is optionally 1-8 or 1-10, where at least one $D1_N$ is present in the top strand and is base paired with a corresponding $D2_N$ in the bottom strand. Optionally, $D1_N$ and $D1_{N+1}$ are base paired with corresponding $D2_N$ and $D2_{N+1}$; $D1_N$, $D1_{N+1}$ and $D1_{N+2}$ are base paired with corresponding $D2_N$, $D1_{N+1}$ and $D1_{N+2}$, etc. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In the structures depicted herein, the 5' end of either the sense strand or antisense strand can optionally comprise a phosphate group.

In another embodiment, a DNA:DNA-extended DsiRNA comprises strands having equal lengths possessing 1-3 mismatched residues that serve to orient Dicer cleavage (specifically, one or more of positions 1, 2 or 3 on the first strand of the DsiRNA, when numbering from the 3'-terminal residue, are mismatched with corresponding residues of the 5'-terminal region on the second strand when first and second strands are annealed to one another). An exemplary DNA:DNA-extended DsiRNA agent with two terminal mismatched residues is shown:

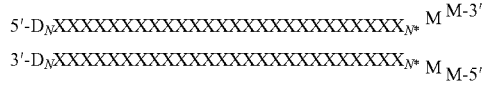

wherein "X"=RNA, "M"=Nucleic acid residues (RNA, DNA or non-natural or modified nucleic acids) that do not base pair (hydrogen bond) with corresponding "M" residues of otherwise complementary strand when strands are annealed, "D"=DNA and "N"=1 to 50 or more, but is optionally 1-15 or, optionally, 1-8. "N*"=0 to 15 or more, but is optionally 0, 1, 2, 3, 4, 5 or 6. Any of the residues of such agents can optionally be 2'-O-methyl RNA monomers—alternating positioning of 2'-O-methyl RNA monomers that commences from the 3'-terminal residue of the bottom (second) strand, as shown for above asymmetric agents, can also be used in the above "blunt/fray" DsiRNA agent. In one embodiment, the top strand (first strand) is the sense strand, and the bottom strand (second strand) is the antisense strand. Alternatively, the bottom strand is the sense strand and the top strand is the antisense strand. Modification and DNA:DNA extension patterns paralleling those shown above for asymmetric/overhang agents can also be incorporated into such "blunt/frayed" agents.

In one embodiment, a length-extended DsiRNA agent is provided that comprises deoxyribonucleotides positioned at sites modeled to function via specific direction of Dicer cleavage, yet which does not require the presence of a base-paired deoxyribonucleotide in the dsRNA structure. An exemplary structure for such a molecule is shown:

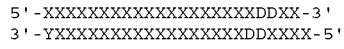

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, and "D"=DNA. In one embodiment, the top strand is the sense strand, and the bottom strand is the antisense strand. Alternatively, the bottom strand is the sense strand and the top strand is the antisense strand. The above structure is modeled to force Dicer to cleave a minimum of a 21mer duplex as its primary post-processing form. In embodiments where the bottom strand of the above structure is the antisense strand, the positioning of two deoxyribonucleotide residues at the ultimate and penultimate residues of the 5' end of the antisense strand will help reduce off-target effects (as prior studies have shown a 2'-O-methyl modification of at least the penultimate position from the 5' terminus of the antisense strand to reduce off-target effects; see, e.g., US 2007/0223427).

In one embodiment, the DsiRNA comprises the following (an exemplary "left-extended", "DNA extended" DsiRNA):

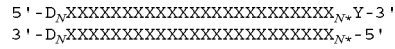

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In a related embodiment, the DsiRNA comprises:

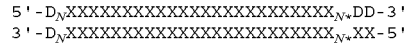

wherein "X"=RNA, optionally a 2'-O-methyl RNA monomers "D"=DNA, "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In an additional embodiment, the DsiRNA comprises:

wherein "X"=RNA, optionally a 2'-O-methyl RNA monomers "D"=DNA, "N"=1 to 50 or more, but is optionally 1-8 or 1-10. "N*"=0 to 15 or more, but is optionally 0, 1, 2, 3, 4, 5 or 6. "Z"=DNA or RNA. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

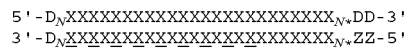

wherein "X"=RNA, optionally a 2'-O-methyl RNA monomers "D"=DNA, "N"=1 to 50 or more, but is optionally 1-8 or 1-10. "N*"=0 to 15 or more, but is optionally 0, 1, 2, 3, 4, 5 or 6. "Z"=DNA or RNA. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

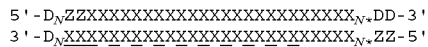

wherein "X"=RNA, "X"=2'-O-methyl RNA, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

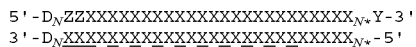

wherein "X"=RNA, "X"=2'-O-methyl RNA, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another embodiment, the DsiRNA comprises:

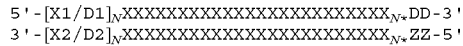

wherein "X"=RNA, "D"=DNA, "Z"=DNA or RNA, and "N"=1 to 50 or more, but is optionally 1-8 or 1-10, where at least one $D1_N$ is present in the top strand and is base paired with a corresponding $D2_N$ in the bottom strand. Optionally, $D1_N$ and $D1_{N+1}$ are base paired with corresponding $D2_N$ and $D2_{N+1}$; $D1_N$, $D1_{N+1}$ and $D1_{N+2}$ are base paired with corresponding $D2_N$, $D1_{N+1}$ and $D1_{N+2}$, etc. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In a related embodiment, the DsiRNA comprises:

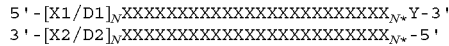

wherein "X"=RNA, "D"=DNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, and "N"=1 to 50 or more, but is optionally 1-8 or 1-10, where at least one $D1_N$ is present in the top strand and is base paired with a corresponding $D2_N$ in the bottom strand. Optionally, $D1_N$ and $D1_{N+1}$ are base paired with corresponding $D2_N$ and $D2_{N+1}$; $D1_N$, $D1_{N+1}$ and $D1_{N+2}$ are base paired with corresponding $D2_N$, $D1_{N+1}$ and $D1_{N+2}$, etc. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another embodiment, the DNA:DNA-extended DsiRNA comprises strands having equal lengths possessing 1-3 mismatched residues that serve to orient Dicer cleavage (specifically, one or more of positions 1, 2 or 3 on the first strand of the DsiRNA, when numbering from the 3'-terminal residue, are mismatched with corresponding residues of the 5'-terminal region on the second strand when first and second strands are annealed to one another). An exemplary DNA:DNA-extended DsiRNA agent with two terminal mismatched residues is shown:

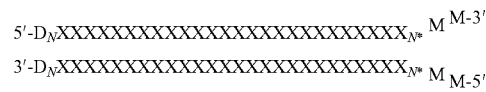

wherein "X"=RNA, "M"=Nucleic acid residues (RNA, DNA or non-natural or modified nucleic acids) that do not base pair (hydrogen bond) with corresponding "M" residues of otherwise complementary strand when strands are annealed, "D"=DNA and "N"=1 to 50 or more, but is optionally 1-8 or 1-10. "N*"=0 to 15 or more, but is optionally 0, 1, 2, 3, 4, 5 or 6. Any of the residues of such agents can optionally be 2'-O-methyl RNA monomers—alternating positioning of 2'-O-methyl RNA monomers that commences from the 3'-terminal residue of the bottom (second) strand, as shown for above asymmetric agents, can also be used in the above "blunt/fray" DsiRNA agent. In one embodiment, the top strand (first strand) is the sense strand, and the bottom strand (second strand) is the antisense strand. Alternatively, the bottom strand is the sense strand and the top strand is the antisense strand. Modification and DNA:DNA extension patterns paralleling those shown above for asymmetric/overhang agents can also be incorporated into such "blunt/frayed" agents.

In another embodiment, a length-extended DsiRNA agent is provided that comprises deoxyribonucleotides positioned at sites modeled to function via specific direction of Dicer cleavage, yet which does not require the presence of a base-paired deoxyribonucleotide in the dsRNA structure. Exemplary structures for such a molecule are shown:

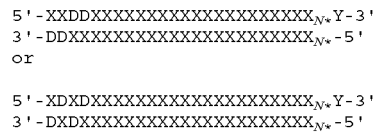

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, and "D"=DNA. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In any of the above embodiments where the bottom strand of the above structure is the antisense strand, the positioning of two deoxyribonucleotide residues at the ultimate and penultimate residues of the 5' end of the antisense strand will help reduce off-target effects (as prior studies have shown a 2'-O-methyl modification of at least the penultimate position from the 5' terminus of the antisense strand to reduce off-target effects; see, e.g., US 2007/0223427).

In certain embodiments, the "D" residues of the above structures include at least one PS-DNA or PS-RNA. Optionally, the "D" residues of the above structures include at least one modified nucleotide that inhibits Dicer cleavage.

While the above-described "DNA-extended" DsiRNA agents can be categorized as either "left extended" or "right extended", DsiRNA agents comprising both left- and right-extended DNA-containing sequences within a single agent (e.g., both flanks surrounding a core dsRNA structure are dsDNA extensions) can also be generated and used in similar manner to those described herein for "right-extended" and "left-extended" agents.

In some embodiments, the DsiRNA of the instant invention further comprises a linking moiety or domain that joins the sense and antisense strands of a DNA:DNA-extended DsiRNA agent. Optionally, such a linking moiety domain joins the 3' end of the sense strand and the 5' end of the antisense strand. The linking moiety may be a chemical (non-nucleotide) linker, such as an oligomethylenediol linker, oligoethylene glycol linker, or other art-recognized linker moiety. Alternatively, the linker can be a nucleotide linker, optionally including an extended loop and/or tetraloop.

In one embodiment, the DsiRNA agent has an asymmetric structure, with the sense strand having a 25-base pair length, and the antisense strand having a 27-base pair length with a 1-4 base 3'-overhang (e.g., a one base 3'-overhang, a two base 3'-overhang, a three base 3'-overhang or a four base 3'-overhang). In another embodiment, this DsiRNA agent has an asymmetric structure further containing 2 deoxynucleotides at the 3' end of the sense strand.

In another embodiment, the DsiRNA agent has an asymmetric structure, with the antisense strand having a 25-base pair length, and the sense strand having a 27-base pair length with a 1-4 base 3'-overhang (e.g., a one base 3'-overhang, a two base 3'-overhang, a three base 3'-overhang or a four base 3'-overhang). In another embodiment, this DsiRNA agent has an asymmetric structure further containing 2 deoxyribonucleotides at the 3' end of the antisense strand.

Exemplary AR targeting DsiRNA agents of the invention include the following:

TABLE 2

Selected Anti-AR DsiRNA Agents

```
                5'-AAGUUUUUAAAAGCUGCUAAAGAct-3'      (SEQ ID NO: 1)
                3'-ACUUCAAAAAUUUUCGACGAUUUCUGA-5'    (SEQ ID NO: 154)

AR-252 Target:  5'-TGAAGTTTTTAAAAGCTGCTAAAGACT-3'    (SEQ ID NO: 307)

5'-AGUUUUUAAAAGCUGCUAAAGACtc-3'     (SEQ ID NO: 2)
                3'-CUUCAAAAAUUUUCGACGAUUUCUGAG-5'   (SEQ ID NO: 155)

AR-253 Target:  5'-GAAGTTTTTAAAAGCTGCTAAAGACTC-3'   (SEQ ID NO: 308)

5'-GUUUUUAAAAGCUGCUAAAGACUcg-3'    (SEQ ID NO: 3)
                3'-UUCAAAAAUUUUCGACGAUUUCUGAGC-5'  (SEQ ID NO: 156)

AR-254 Target:  5'-AAGTTTTTAAAAGCTGCTAAAGACTCG-3'  (SEQ ID NO: 309)

5'-CGGAGCCAGAGAUCAAAAGAUGAaa-3'     (SEQ ID NO: 4)
                3'-ACGCCUCGGUCUCUAGUUUUCUACUUU-5'   (SEQ ID NO: 157)

AR-682 Target:  5'-TGCGGAGCCAGAGATCAAAAGATGAAA-3'   (SEQ ID NO: 310)

5'-CAGAGAUCAAAAGAUGAAAAGGCag-3'     (SEQ ID NO: 5)
                3'-CGGUCUCUAGUUUUCUACUUUUCCGUC-5'   (SEQ ID NO: 158)

AR-688 Target:  5'-GCCAGAGATCAAAAGATGAAAAGGCAG-3'   (SEQ ID NO: 311)

5'-AGAGAUCAAAAGAUGAAAAGGCAgt-3'     (SEQ ID NO: 6)
                3'-GGUCUCUAGUUUUCUACUUUUCCGUCA-5'   (SEQ ID NO: 159)

AR-689 Target:  5'-CCAGAGATCAAAAGATGAAAAGGCAGT-3'   (SEQ ID NO: 312)

5'-AAAGAUGAAAAGGCAGUCAGGUCtt-3'     (SEQ ID NO: 7)
                3'-GUUUUCUACUUUUCCGUCAGUCCAGAA-5'   (SEQ ID NO: 160)

AR-697 Target:  5'-CAAAAGATGAAAAGGCAGTCAGGTCTT-3'   (SEQ ID NO: 313)

5'-AAGAUGAAAAGGCAGUCAGGUCUtc-3'     (SEQ ID NO: 8)
                3'-UUUUCUACUUUUCCGUCAGUCCAGAAG-5'   (SEQ ID NO: 161)

AR-698 Target:  5'-AAAAGATGAAAAGGCAGTCAGGTCTTC-3'   (SEQ ID NO: 314)

5'-CAGGUCUUCAGUAGCCAAAAAACaa-3'     (SEQ ID NO: 9)
                3'-CAGUCCAGAAGUCAUCGGUUUUUUGUU-5'   (SEQ ID NO: 162)

AR-714 Target:  5'-GTCAGGTCTTCAGTAGCCAAAAAACAA-3'   (SEQ ID NO: 315)

5'-AGGUCUUCAGUAGCCAAAAAACAaa-3'     (SEQ ID NO: 10)
                3'-AGUCCAGAAGUCAUCGGUUUUUUGUUU-5'   (SEQ ID NO: 163)
```

TABLE 2-continued

Selected Anti-AR DsiRNA Agents

AR-715 Target: 5'-TCAGGTCTTCAGTAGCCAAAAACAAA-3' (SEQ ID NO: 316)

5'-GUAGCCAAAAACAAACAAACAaa-3' (SEQ ID NO: 11)
3'-GUCAUCGGUUUUUGUUUUGUUUGUUU-5' (SEQ ID NO: 164)

AR-724 Target: 5'-CAGTAGCCAAAAACAAACAAACAAA-3' (SEQ ID NO: 317)

5'-CAAAAACAAACAAACAAAAACaa-3' (SEQ ID NO: 12)
3'-CGGUUUUUUGUUUUGUUUGUUUUGUU-5' (SEQ ID NO: 165)

AR-729 Target: 5'-GCCAAAAACAAACAAACAAAAACAA-3' (SEQ ID NO: 318)

5'-AAAAAACAAACAAACAAAAACAaa-3' (SEQ ID NO: 13)
3'-GGUUUUUUGUUUUGUUUGUUUUGUUU-5' (SEQ ID NO: 166)

AR-730 Target: 5'-CCAAAAACAAACAAACAAAAACAAA-3' (SEQ ID NO: 319)

5'-AAAACAAACAAAAACAAAAAGCcg-3' (SEQ ID NO: 14)
3'-UGUUUUGUUUGUUUUGUUUUUCGGC-5' (SEQ ID NO: 167)

AR-737 Target: 5'-ACAAAACAAACAAAAACAAAAAGCCG-3' (SEQ ID NO: 320)

5'-CAAAAACAAAAAGCCGAAAUAAaa-3' (SEQ ID NO: 15)
3'-UUGUUUUUGUUUUUCGGCUUUAUUUU-5' (SEQ ID NO: 168)

AR-745 Target: 5'-AACAAAAACAAAAAGCCGAAATAAAA-3' (SEQ ID NO: 321)

5'-AAAAACAAAAAGCCGAAAUAAAag-3' (SEQ ID NO: 16)
3'-UGUUUUUGUUUUUCGGCUUUAUUUUC-5' (SEQ ID NO: 169)

AR-746 Target: 5'-ACAAAAACAAAAAGCCGAAATAAAAG-3' (SEQ ID NO: 322)

5'-AAAACAAAAAGCCGAAAUAAAAga-3' (SEQ ID NO: 17)
3'-GUUUUUGUUUUUCGGCUUUAUUUUCU-5' (SEQ ID NO: 170)

AR-747 Target: 5'-CAAAAACAAAAAGCCGAAATAAAGA-3' (SEQ ID NO: 323)

5'-AAAAAAGCCGAAAUAAAAGAAAag-3' (SEQ ID NO: 18)
3'-UGUUUUUUCGGCUUUAUUUUCUUUUUC-5' (SEQ ID NO: 171)

AR-752 Target: 5'-ACAAAAAGCCGAAATAAAAGAAAAG-3' (SEQ ID NO: 324)

5'-AAAAAGCCGAAAUAAAAGAAAAga-3' (SEQ ID NO: 19)
3'-GUUUUUUCGGCUUUAUUUUCUUUUUCU-5' (SEQ ID NO: 172)

AR-753 Target: 5'-CAAAAAAGCCGAAATAAAAGAAAAGA-3' (SEQ ID NO: 325)

5'-AAAGCCGAAAUAAAAGAAAAGAta-3' (SEQ ID NO: 20)
3'-UUUUUCGGCUUUAUUUUCUUUUUCUAU-5' (SEQ ID NO: 173)

AR-755 Target: 5'-AAAAAGCCGAAATAAAAGAAAAGATA-3' (SEQ ID NO: 326)

5'-CGAAAUAAAAGAAAAGAUAAUAac-3' (SEQ ID NO: 21)
3'-CGGCUUUAUUUUCUUUUUCUAUUAUUG-5' (SEQ ID NO: 174)

AR-760 Target: 5'-GCCGAAATAAAAGAAAAGATAATAAC-3' (SEQ ID NO: 327)

5'-GAAAUAAAAGAAAAGAUAAUAAct-3' (SEQ ID NO: 22)
3'-GGCUUUAUUUUCUUUUUCUAUUAUUGA-5' (SEQ ID NO: 175)

AR-761 Target: 5'-CCGAAATAAAAGAAAAGATAATAACT-3' (SEQ ID NO: 328)

5'-AAAUAAAAGAAAAGAUAAUAACtc-3' (SEQ ID NO: 23)
3'-GCUUUAUUUUCUUUUUCUAUUAUUGAG-5' (SEQ ID NO: 176)

AR-762 Target: 5'-CGAAATAAAAGAAAAGATAATAACTC-3' (SEQ ID NO: 329)

5'-GAAAAGAUAAUAACUCAGUUCUta-3' (SEQ ID NO: 24)
3'-UUCUUUUUCUAUUAUUGAGUCAAGAAU-5' (SEQ ID NO: 177)

AR-770 Target: 5'-AAGAAAAGATAATAACTCAGTTCTTA-3' (SEQ ID NO: 330)

5'-AAGAUAAUAACUCAGUUCUUAUUtg-3' (SEQ ID NO: 25)
3'-UUUUCUAUUAUUGAGUCAAGAAUAAAC-5' (SEQ ID NO: 178)

TABLE 2-continued

Selected Anti-AR DsiRNA Agents

```
AR-774 Target:   5'-AAAAGATAATAACTCAGTTCTTATTTG-3'      (SEQ ID NO: 331)

5'-AGAUAAUAACUCAGUUCUUAUUUGgc-3'       (SEQ ID NO: 26)
                 3'-UUUCUAUUAUUGAGUCAAGAAUAAACG-5'      (SEQ ID NO: 179)

AR-775 Target:   5'-AAAGATAATAACTCAGTTCTTATTTGC-3'      (SEQ ID NO: 332)

5'-AUAAUAACUCAGUUCUUAUUUGCac-3'        (SEQ ID NO: 27)
                 3'-UCUAUUAUUGAGUCAAGAAUAAACGUG-5'      (SEQ ID NO: 180)

AR-777 Target:   5'-AGATAATAACTCAGTTCTTATTTGCAC-3'      (SEQ ID NO: 333)

5'-UAAUAACUCAGUUCUUAUUUGCAcc-3'        (SEQ ID NO: 28)
                 3'-CUAUUAUUGAGUCAAGAAUAAACGUGG-5'      (SEQ ID NO: 181)

AR-778 Target:   5'-GATAATAACTCAGTTCTTATTTGCACC-3'      (SEQ ID NO: 334)

5'-UUAUUUGCACCUACUUCAGUGGAca-3'        (SEQ ID NO: 29)
                 3'-AGAAUAAACGUGGAUGAAGUCACCUGU-5'      (SEQ ID NO: 182)

AR-792 Target:   5'-TCTTATTTGCACCTACTTCAGTGGACA-3'      (SEQ ID NO: 335)

5'-AGUGGACACUGAAUUUGGAAGGUgg-3'        (SEQ ID NO: 30)
                 3'-AGUCACCUGUGACUUAAACCUUCCACC-5'      (SEQ ID NO: 183)

AR-809 Target:   5'-TCAGTGGACACTGAATTTGGAAGGTGG-3'      (SEQ ID NO: 336)

5'-CUGAAUUUGGAAGGUGGAGGAUUtt-3'        (SEQ ID NO: 31)
                 3'-GUGACUUAAACCUUCCACCUCCUAAAA-5'      (SEQ ID NO: 184)

AR-817 Target:   5'-CACTGAATTTGGAAGGTGGAGGATTTT-3'      (SEQ ID NO: 337)

5'-UGGAAGGUGGAGGAUUUUGUUUUtt-3'        (SEQ ID NO: 32)
                 3'-AAACCUUCCACCUCCUAAAACAAAAAA-5'      (SEQ ID NO: 185)

AR-824 Target:   5'-TTTGGAAGGTGGAGGATTTTGTTTTTT-3'      (SEQ ID NO: 338)

5'-AAGGUGGAGGAUUUUGUUUUUUUct-3'        (SEQ ID NO: 33)
                 3'-CCUUCCACCUCCUAAAACAAAAAAAGA-5'      (SEQ ID NO: 186)

AR-827 Target:   5'-GGAAGGTGGAGGATTTTGTTTTTTTCT-3'      (SEQ ID NO: 339)

5'-GAGGAUUUUGUUUUUUUCUUUUAag-3'        (SEQ ID NO: 34)
                 3'-ACCUCCUAAAACAAAAAAAGAAAAUUC-5'      (SEQ ID NO: 187)

AR-833 Target:   5'-TGGAGGATTTTGTTTTTTTCTTTTAAG-3'      (SEQ ID NO: 340)

5'-AGGAUUUUGUUUUUUUCUUUUAAga-3'        (SEQ ID NO: 35)
                 3'-CCUCCUAAAACAAAAAAAGAAAAUUCU-5'      (SEQ ID NO: 188)

AR-834 Target:   5'-GGAGGATTTTGTTTTTTTCTTTTAAGA-3'      (SEQ ID NO: 341)

5'-GAUUUUGUUUUUUUCUUUUAAGAtc-3'        (SEQ ID NO: 36)
                 3'-UCCUAAAACAAAAAAAGAAAAUUCUAG-5'      (SEQ ID NO: 189)

AR-836 Target:   5'-AGGATTTTGTTTTTTTCTTTTAAGATC-3'      (SEQ ID NO: 342)

5'-AUUUUGUUUUUUUCUUUUAAGAUct-3'        (SEQ ID NO: 37)
                 3'-CCUAAAACAAAAAAAGAAAAUUCUAGA-5'      (SEQ ID NO: 190)

AR-837 Target:   5'-GGATTTTGTTTTTTTCTTTTAAGATCT-3'      (SEQ ID NO: 343)

5'-UUUUGUUUUUUUCUUUUAAGAUCtg-3'        (SEQ ID NO: 38)
                 3'-CUAAAACAAAAAAAGAAAAUUCUAGAC-5'      (SEQ ID NO: 191)

AR-838 Target:   5'-GATTTTGTTTTTTTCTTTTAAGATCTG-3'      (SEQ ID NO: 344)

5'-UUUGUUUUUUUCUUUUAAGAUCUgg-3'        (SEQ ID NO: 39)
                 3'-UAAAACAAAAAAAGAAAAUUCUAGACC-5'      (SEQ ID NO: 192)

AR-839 Target:   5'-ATTTTGTTTTTTTCTTTTAAGATCTGG-3'      (SEQ ID NO: 345)

5'-UUUUUUUCUUUUAAGAUCUGGGCat-3'        (SEQ ID NO: 40)
                 3'-ACAAAAAAAGAAAAUUCUAGACCCGUA-5'      (SEQ ID NO: 193)
```

TABLE 2-continued

Selected Anti-AR DsiRNA Agents

```
AR-843 Target:   5'-TGTTTTTTTCTTTTAAGATCTGGGCAT-3'    (SEQ ID NO: 346)

5'-UUUUUUCUUUUAAGAUCUGGGCAtc-3'      (SEQ ID NO: 41)
                 3'-CAAAAAAAGAAAAUUCUAGACCCGUAG-5'    (SEQ ID NO: 194)

AR-844 Target:   5'-GTTTTTTTCTTTTAAGATCTGGGCATC-3'    (SEQ ID NO: 347)

5'-UAAGAUCUGGGCAUCUUUUGAAUct-3'      (SEQ ID NO: 42)
                 3'-AAAUUCUAGACCCGUAGAAAACUUAGA-5'    (SEQ ID NO: 195)

AR-854 Target:   5'-TTTAAGATCTGGGCATCTTTTGAATCT-3'    (SEQ ID NO: 348)

5'-CUUUUGAAUCUACCCUUCAAGUAtt-3'      (SEQ ID NO: 43)
                 3'-UAGAAAACUUAGAUGGGAAGUUCAUAA-5'    (SEQ ID NO: 196)

AR-868 Target:   5'-ATCTTTTGAATCTACCCTTCAAGTATT-3'    (SEQ ID NO: 349)

5'-UUUUGAAUCUACCCUUCAAGUAUta-3'      (SEQ ID NO: 44)
                 3'-AGAAAACUUAGAUGGGAAGUUCAUAAU-5'    (SEQ ID NO: 197)

AR-869 Target:   5'-TCTTTTGAATCTACCCTTCAAGTATTA-3'    (SEQ ID NO: 350)

5'-UUUGAAUCUACCCUUCAAGUAUUaa-3'      (SEQ ID NO: 45)
                 3'-GAAAACUUAGAUGGGAAGUUCAUAAUU-5'    (SEQ ID NO: 198)

AR-870 Target:   5'-CTTTTGAATCTACCCTTCAAGTATTAA-3'    (SEQ ID NO: 351)

5'-UUGAAUCUACCCUUCAAGUAUUAag-3'      (SEQ ID NO: 46)
                 3'-AAAACUUAGAUGGGAAGUUCAUAAUUC-5'    (SEQ ID NO: 199)

AR-871 Target:   5'-TTTTGAATCTACCCTTCAAGTATTAAG-3'    (SEQ ID NO: 352)

5'-UGAAUCUACCCUUCAAGUAUUAAga-3'      (SEQ ID NO: 47)
                 3'-AAACUUAGAUGGGAAGUUCAUAAUUCU-5'    (SEQ ID NO: 200)

AR-872 Target:   5'-TTTGAATCTACCCTTCAAGTATTAAGA-3'    (SEQ ID NO: 353)

5'-AAGUAUUAAGAGACAGACUGUGAgc-3'      (SEQ ID NO: 48)
                 3'-AGUUCAUAAUUCUCUGUCUGACACUCG-5'    (SEQ ID NO: 201)

AR-886 Target:   5'-TCAAGTATTAAGAGACAGACTGTGAGC-3'    (SEQ ID NO: 354)

5'-UAUUAAGAGACAGACUGUGAGCCta-3'      (SEQ ID NO: 49)
                 3'-UCAUAAUUCUCUGUCUGACACUCGGAU-5'    (SEQ ID NO: 202)

AR-889 Target:   5'-AGTATTAAGAGACAGACTGTGAGCCTA-3'    (SEQ ID NO: 355)

5'-GUUGAACUCUUCUGAGCAAGAGAag-3'      (SEQ ID NO: 50)
                 3'-GACAACUUGAGAAGACUCGUUCUCUUC-5'    (SEQ ID NO: 203)

AR-1067 Target:  5'-CTGTTGAACTCTTCTGAGCAAGAGAAG-3'    (SEQ ID NO: 356)

5'-UUGAACUCUUCUGAGCAAGAGAAgg-3'      (SEQ ID NO: 51)
                 3'-ACAACUUGAGAAGACUCGUUCUCUUCC-5'    (SEQ ID NO: 204)

AR-1068 Target:  5'-TGTTGAACTCTTCTGAGCAAGAGAAGG-3'    (SEQ ID NO: 357)

5'-AGGAUGGAAGUGCAGUUAGGGCUgg-3'      (SEQ ID NO: 52)
                 3'-GUUCCUACCUUCACGUCAAUCCCGACC-5'    (SEQ ID NO: 205)

AR-1137 Target:  5'-CAAGGATGGAAGTGCAGTTAGGGCTGG-3'    (SEQ ID NO: 358)

5'-GAGGAGCUUUCCAGAAUCUGUUCca-3'      (SEQ ID NO: 53)
                 3'-GGCUCCUCGAAAGGUCUUAGACAAGGU-5'    (SEQ ID NO: 206)

AR-1198 Target:  5'-CCGAGGAGCTTTCCAGAATCTGTTCCA-3'    (SEQ ID NO: 359)

5'-AGGAGCUUUCCAGAAUCUGUUCCag-3'      (SEQ ID NO: 54)
                 3'-GCUCCUCGAAAGGUCUUAGACAAGGUC-5'    (SEQ ID NO: 207)

AR-1199 Target:  5'-CGAGGAGCTTTCCAGAATCTGTTCCAG-3'    (SEQ ID NO: 360)

5'-CUGACCUUAAAGACAUCCUGAGCga-3'      (SEQ ID NO: 55)
                 3'-GCGACUGGAAUUUCUGUAGGACUCGCU-5'    (SEQ ID NO: 208)
```

TABLE 2-continued

Selected Anti-AR DsiRNA Agents

```
AR-1675 Target:  5'-CGCTGACCTTAAAGACATCCTGAGCGA-3'    (SEQ ID NO: 361)

5'-CAAGGACAAUUACUUAGGGGGCAct-3'     (SEQ ID NO: 56)
                 3'-AGGUUCCUGUUAAUGAAUCCCCCGUGA-5'   (SEQ ID NO: 209)

AR-1802 Target:  5'-TCCAAGGACAATTACTTAGGGGGCACT-3'   (SEQ ID NO: 362)

5'-AAGGAGUUGUGUAAGGCAGUGUCgg-3'     (SEQ ID NO: 57)
                 3'-GGUUCCUCAACACAUUCCGUCACAGCC-5'   (SEQ ID NO: 210)

AR-1848 Target:  5'-CCAAGGAGTTGTGTAAGGCAGTGTCGG-3'   (SEQ ID NO: 363)

5'-CUGAAGAUACUGCUGAGUAUUCCcc-3'     (SEQ ID NO: 58)
                 3'-GUGACUUCUAUGACGACUCAUAAGGGG-5'   (SEQ ID NO: 211)

AR-2047 Target:  5'-CACTGAAGATACTGCTGAGTATTCCCC-3'   (SEQ ID NO: 364)

5'-CUGAGUAUUCCCCUUUCAAGGGAgg-3'     (SEQ ID NO: 59)
                 3'-ACGACUCAUAAGGGGAAAGUUCCCUCC-5'   (SEQ ID NO: 212)

AR-2059 Target:  5'-TGCTGAGTATTCCCCTTTCAAGGGAGG-3'   (SEQ ID NO: 365)

5'-CUUGUGUCAAAAGCGAAAUGGGCcc-3'     (SEQ ID NO: 60)
                 3'-GUGAACACAGUUUUCGCUUUACCCGGG-5'   (SEQ ID NO: 213)

AR-2692 Target:  5'-CACTTGTGTCAAAAGCGAAATGGGCCC-3'   (SEQ ID NO: 366)

5'-UUGUGUCAAAAGCGAAAUGGGCCcc-3'     (SEQ ID NO: 61)
                 3'-UGAACACAGUUUUCGCUUUACCCGGGG-5'   (SEQ ID NO: 214)

AR-2693 Target:  5'-ACTTGTGTCAAAAGCGAAATGGGCCCC-3'   (SEQ ID NO: 367)

5'-CAUGUUUUGCCCAUUGACUAUUAct-3'     (SEQ ID NO: 62)
                 3'-UGGUACAAAACGGGUAACUGAUAAUGA-5'   (SEQ ID NO: 215)

AR-2775 Target:  5'-ACCATGTTTTGCCCATTGACTATTACT-3'   (SEQ ID NO: 368)

5'-UGUUUUGCCCAUUGACUAUUACUtt-3'     (SEQ ID NO: 63)
                 3'-GUACAAAACGGGUAACUGAUAAUGAAA-5'   (SEQ ID NO: 216)

AR-2777 Target:  5'-CATGTTTTGCCCATTGACTATTACTTT-3'   (SEQ ID NO: 369)

5'-GUGGAGAUGAAGCUUCUGGGUGUca-3'     (SEQ ID NO: 64)
                 3'-GACACCUCUACUUCGAAGACCCACAGU-5'   (SEQ ID NO: 217)

AR-2827 Target:  5'-CTGTGGAGATGAAGCTTCTGGGTGTCA-3'   (SEQ ID NO: 370)

5'-AAGGGAAACAGAAGUACCUGUGCgc-3'     (SEQ ID NO: 65)
                 3'-ACUUCCCUUUGUCUUCAUGGACACGCG-5'   (SEQ ID NO: 218)

AR-2905 Target:  5'-TGAAGGGAAACAGAAGTACCTGTGCGC-3'   (SEQ ID NO: 371)

5'-AGAAAUGAUUGCACUAUUGAUAAat-3'     (SEQ ID NO: 66)
                 3'-CGUCUUUACUAACGUGAUAACUAUUUA-5'   (SEQ ID NO: 219)

AR-2934 Target:  5'-GCAGAAATGATTGCACTATTGATAAAT-3'   (SEQ ID NO: 372)

5'-GAAAUGAUUGCACUAUUGAUAAAtt-3'     (SEQ ID NO: 67)
                 3'-GUCUUUACUAACGUGAUAACUAUUUAA-5'   (SEQ ID NO: 220)

AR-2935 Target:  5'-CAGAAATGATTGCACTATTGATAAATT-3'   (SEQ ID NO: 373)

5'-AAAUGAUUGCACUAUUGAUAAAUtc-3'     (SEQ ID NO: 68)
                 3'-UCUUUACUAACGUGAUAACUAUUUAAG-5'   (SEQ ID NO: 221)

AR-2936 Target:  5'-AGAAATGATTGCACTATTGATAAATTC-3'   (SEQ ID NO: 374)

5'-AUGAUUGCACUAUUGAUAAAUUCcg-3'     (SEQ ID NO: 69)
                 3'-UUUACUAACGUGAUAACUAUUUAAGGC-5'   (SEQ ID NO: 222)

AR-2938 Target:  5'-AAATGATTGCACTATTGATAAATTCCG-3'   (SEQ ID NO: 375)

5'-UGAUUGCACUAUUGAUAAAUUCCga-3'     (SEQ ID NO: 70)
                 3'-UUACUAACGUGAUAACUAUUUAAGGCU-5'   (SEQ ID NO: 223)
```

TABLE 2-continued

Selected Anti-AR DsiRNA Agents

```
AR-2939 Target:  5'-AATGATTGCACTATTGATAAATTCCGA-3'      (SEQ ID NO: 376)

5'-CUAUUGAUAAAUUCCGAAGGAAAaa-3'       (SEQ ID NO: 71)
                 3'-GUGAUAACUAUUUAAGGCUUCCUUUUU-5'     (SEQ ID NO: 224)

AR-2947 Target:  5'-CACTATTGATAAATTCCGAAGGAAAAA-3'     (SEQ ID NO: 377)

5'-UAUUGAUAAAUUCCGAAGGAAAAat-3'       (SEQ ID NO: 72)
                 3'-UGAUAACUAUUUAAGGCUUCCUUUUUA-5'     (SEQ ID NO: 225)

AR-2948 Target:  5'-ACTATTGATAAATTCCGAAGGAAAAAT-3'     (SEQ ID NO: 378)

5'-AUUGAUAAAUUCCGAAGGAAAAAtt-3'       (SEQ ID NO: 73)
                 3'-GAUAACUAUUUAAGGCUUCCUUUUUAA-5'     (SEQ ID NO: 226)

AR-2949 Target:  5'-CTATTGATAAATTCCGAAGGAAAAATT-3'     (SEQ ID NO: 379)

5'-UUGAUAAAUUCCGAAGGAAAAAUtg-3'      (SEQ ID NO: 74)
                 3'-AUAACUAUUUAAGGCUUCCUUUUUAAC-5'     (SEQ ID NO: 227)

AR-2950 Target:  5'-TATTGATAAATTCCGAAGGAAAAATTG-3'     (SEQ ID NO: 380)

5'-UGAUAAAUUCCGAAGGAAAAAUUgt-3'      (SEQ ID NO: 75)
                 3'-UAACUAUUUAAGGCUUCCUUUUUAACA-5'    (SEQ ID NO: 228)

AR-2951 Target:  5'-ATTGATAAATTCCGAAGGAAAAATTGT-3'     (SEQ ID NO: 381)

5'-AUAAAUUCCGAAGGAAAAAUUGUcc-3'      (SEQ ID NO: 76)
                 3'-ACUAUUUAAGGCUUCCUUUUUAACAGG-5'    (SEQ ID NO: 229)

AR-2953 Target:  5'-TGATAAATTCCGAAGGAAAAATTGTCC-3'     (SEQ ID NO: 382)

5'-UAAAUUCCGAAGGAAAAAUUGUCca-3'      (SEQ ID NO: 77)
                 3'-CUAUUUAAGGCUUCCUUUUUAACAGGU-5'    (SEQ ID NO: 230)

AR-2954 Target:  5'-GATAAATTCCGAAGGAAAAATTGTCCA-3'     (SEQ ID NO: 383)

5'-AAGGAAAAAUUGUCCAUCUUGUCgt-3'      (SEQ ID NO: 78)
                 3'-GCUUCCUUUUUAACAGGUAGAACAGCA-5'    (SEQ ID NO: 231)

AR-2963 Target:  5'-CGAAGGAAAAATTGTCCATCTTGTCGT-3'     (SEQ ID NO: 384)

5'-CUUGUCGUCUUCGGAAAUGUUAUga-3'      (SEQ ID NO: 79)
                 3'-UAGAACAGCAGAAGCCUUUACAAUACU-5'    (SEQ ID NO: 232)

AR-2980 Target:  5'-ATCTTGTCGTCTTCGGAAATGTTATGA-3'     (SEQ ID NO: 385)

5'-GAAAUGUUAUGAAGCAGGGAUGAct-3'      (SEQ ID NO: 80)
                 3'-GCCUUUACAAUACUUCGUCCCUACUGA-5'    (SEQ ID NO: 233)

AR-2993 Target:  5'-CGGAAATGTTATGAAGCAGGGATGACT-3'     (SEQ ID NO: 386)

5'-AAUGUUAUGAAGCAGGGAUGACUct-3'      (SEQ ID NO: 81)
                 3'-CUUUACAAUACUUCGUCCCUACUGAGA-5'    (SEQ ID NO: 234)

AR-2995 Target:  5'-GAAATGTTATGAAGCAGGGATGACTCT-3'     (SEQ ID NO: 387)

5'-CGGAAGCUGAAGAAACUUGGUAAtc-3'      (SEQ ID NO: 82)
                 3'-GGGCCUUCGACUUCUUUGAACCAUUAG-5'    (SEQ ID NO: 235)

AR-3027 Target:  5'-CCCGGAAGCTGAAGAAACTTGGTAATC-3'     (SEQ ID NO: 388)

5'-GAAGCUGAAGAAACUUGGUAAUCtg-3'      (SEQ ID NO: 83)
                 3'-GCCUUCGACUUCUUUGAACCAUUAGAC-5'    (SEQ ID NO: 236)

AR-3029 Target:  5'-CGGAAGCTGAAGAAACTTGGTAATCTG-3'     (SEQ ID NO: 389)

5'-UGAAGAAACUUGGUAAUCUGAAAct-3'      (SEQ ID NO: 84)
                 3'-CGACUUCUUUGAACCAUUAGACUUUGA-5'    (SEQ ID NO: 237)

AR-3034 Target:  5'-GCTGAAGAAACTTGGTAATCTGAAACT-3'     (SEQ ID NO: 390)

5'-GAAGAAACUUGGUAAUCUGAAACta-3'      (SEQ ID NO: 85)
                 3'-GACUUCUUUGAACCAUUAGACUUUGAU-5'    (SEQ ID NO: 238)
```

TABLE 2-continued

Selected Anti-AR DsiRNA Agents

```
AR-3035  Target:  5'-CTGAAGAAACTTGGTAATCTGAAACTA-3'        (SEQ ID NO: 391)

5'-AAGAAACUUGGUAAUCUGAAACUac-3'          (SEQ ID NO: 86)
                  3'-ACUUCUUUGAACCAUUAGACUUUGAUG-5'        (SEQ ID NO: 239)

AR-3036  Target:  5'-TGAAGAAACTTGGTAATCTGAAACTAC-3'       (SEQ ID NO: 392)

5'-GGUAAUCUGAAACUACAGGAGGAag-3'          (SEQ ID NO: 87)
                  3'-AACCAUUAGACUUUGAUGUCCUCCUUC-5'        (SEQ ID NO: 240)

AR-3045  Target:  5'-TTGGTAATCTGAAACTACAGGAGGAAG-3'       (SEQ ID NO: 393)

5'-CUGAAACUACAGGAGGAAGGAGAgg-3'          (SEQ ID NO: 88)
                  3'-UAGACUUUGAUGUCCUCCUUCCUCUCC-5'        (SEQ ID NO: 241)

AR-3051  Target:  5'-ATCTGAAACTACAGGAGGAAGGAGAGG-3'       (SEQ ID NO: 394)

5'-CAGGAAUUCCUGUGCAUGAAAGCac-3'          (SEQ ID NO: 89)
                  3'-GGGUCCUUAAGGACACGUACUUUCGUG-5'        (SEQ ID NO: 242)

AR-3546  Target:  5'-CCCAGGAATTCCTGTGCATGAAAGCAC-3'       (SEQ ID NO: 395)

5'-AGGAAUUCCUGUGCAUGAAAGCAct-3'          (SEQ ID NO: 90)
                  3'-GGUCCUUAAGGACACGUACUUUCGUGA-5'        (SEQ ID NO: 243)

AR-3547  Target:  5'-CCAGGAATTCCTGTGCATGAAAGCACT-3'       (SEQ ID NO: 396)

5'-GGAUGGGCUGAAAAAUCAAAAAUtc-3'          (SEQ ID NO: 91)
                  3'-CACCUACCCGACUUUUUAGUUUUUAAG-5'        (SEQ ID NO: 244)

AR-3596  Target:  5'-GTGGATGGGCTGAAAAATCAAAAATTC-3'       (SEQ ID NO: 397)

5'-GAUGGGCUGAAAAAUCAAAAAUUct-3'          (SEQ ID NO: 92)
                  3'-ACCUACCCGACUUUUUAGUUUUUAAGA-5'        (SEQ ID NO: 245)

AR-3597  Target:  5'-TGGATGGGCTGAAAAATCAAAAATTCT-3'       (SEQ ID NO: 398)

5'-UGGGCUGAAAAAUCAAAAAUUCUtt-3'          (SEQ ID NO: 93)
                  3'-CUACCCGACUUUUUAGUUUUUAAGAAA-5'        (SEQ ID NO: 246)

AR-3599  Target:  5'-GATGGGCTGAAAAATCAAAAATTCTTT-3'       (SEQ ID NO: 399)

5'-CUGAAAAAUCAAAAAUUCUUUGAtg-3'          (SEQ ID NO: 94)
                  3'-CCGACUUUUUAGUUUUUAAGAAACUAC-5'        (SEQ ID NO: 247)

AR-3603  Target:  5'-GGCTGAAAAATCAAAAATTCTTTGATG-3'       (SEQ ID NO: 400)

5'-UGAAAAAUCAAAAAUUCUUUGAUga-3'          (SEQ ID NO: 95)
                  3'-CGACUUUUUAGUUUUUAAGAAACUACU-5'        (SEQ ID NO: 248)

AR-3604  Target:  5'-GCTGAAAAATCAAAAATTCTTTGATGA-3'       (SEQ ID NO: 401)

5'-AAAAAUCAAAAAUUCUUUGAUGAac-3'          (SEQ ID NO: 96)
                  3'-ACUUUUUAGUUUUUAAGAAACUACUUG-5'        (SEQ ID NO: 249)

AR-3606  Target:  5'-TGAAAAATCAAAAATTCTTTGATGAAC-3'       (SEQ ID NO: 402)

5'-AAAAUCAAAAAUUCUUUGAUGAAct-3'          (SEQ ID NO: 97)
                  3'-CUUUUUAGUUUUUAAGAAACUACUUGA-5'        (SEQ ID NO: 250)

AR-3607  Target:  5'-GAAAAATCAAAAATTCTTTGATGAACT-3'       (SEQ ID NO: 403)

5'-AAAUCAAAAAUUCUUUGAUGAACtt-3'          (SEQ ID NO: 98)
                  3'-UUUUUAGUUUUUAAGAAACUACUUGAA-5'        (SEQ ID NO: 251)

AR-3608  Target:  5'-AAAAATCAAAAATTCTTTGATGAACTT-3'       (SEQ ID NO: 404)

5'-CGAAUGAACUACAUCAAGGAACUcg-3'          (SEQ ID NO: 99)
                  3'-AAGCUUACUUGAUGUAGUUCCUUGAGC-5'        (SEQ ID NO: 252)

AR-3633  Target:  5'-TTCGAATGAACTACATCAAGGAACTCG-3'       (SEQ ID NO: 405)

5'-AAGGAACUCGAUCGUAUCAUUGCat-3'          (SEQ ID NO: 100)
                  3'-AGUUCCUUGAGCUAGCAUAGUAACGUA-5'        (SEQ ID NO: 253)
```

TABLE 2-continued

Selected Anti-AR DsiRNA Agents

```
AR-3648  Target:  5'-TCAAGGAACTCGATCGTATCATTGCAT-3'    (SEQ ID NO: 406)

5'-AGGAACUCGAUCGUAUCAUUGCAtg-3'      (SEQ ID NO: 101)
                  3'-GUUCCUUGAGCUAGCAUAGUAACGUAC-5'    (SEQ ID NO: 254)

AR-3649  Target:  5'-CAAGGAACTCGATCGTATCATTGCATG-3'    (SEQ ID NO: 407)

5'-CGUAUCAUUGCAUGCAAAAGAAAaa-3'      (SEQ ID NO: 102)
                  3'-UAGCAUAGUAACGUACGUUUUCUUUUU-5'    (SEQ ID NO: 255)

AR-3660  Target:  5'-ATCGTATCATTGCATGCAAAAGAAAAA-3'    (SEQ ID NO: 408)

5'-GUAUCAUUGCAUGCAAAAGAAAAaa-3'      (SEQ ID NO: 103)
                  3'-AGCAUAGUAACGUACGUUUUCUUUUUU-5'    (SEQ ID NO: 256)

AR-3661  Target:  5'-TCGTATCATTGCATGCAAAAGAAAAAA-3'    (SEQ ID NO: 409)

5'-CAUUGCAUGCAAAAGAAAAAAUCcc-3'      (SEQ ID NO: 104)
                  3'-UAGUAACGUACGUUUUCUUUUUUAGGG-5'    (SEQ ID NO: 257)

AR-3665  Target:  5'-ATCATTGCATGCAAAAGAAAAAATCCC-3'    (SEQ ID NO: 410)

5'-CUUUUGACCUGCUAAUCAAGUCAca-3'      (SEQ ID NO: 105)
                  3'-GUGAAAACUGGACGAUUAGUUCAGUGU-5'    (SEQ ID NO: 258)

AR-3772  Target:  5'-CACTTTTGACCTGCTAATCAAGTCACA-3'    (SEQ ID NO: 411)

5'-GUGGACUUUCCGGAAAUGAUGGCag-3'      (SEQ ID NO: 106)
                  3'-CGCACCUGAAAGGCCUUUACUACCGUC-5'    (SEQ ID NO: 259)

AR-3807  Target:  5'-GCGTGGACTTTCCGGAAATGATGGCAG-3'    (SEQ ID NO: 412)

5'-UGGACUUUCCGGAAAUGAUGGCAga-3'      (SEQ ID NO: 107)
                  3'-GCACCUGAAAGGCCUUUACUACCGUCU-5'    (SEQ ID NO: 260)

AR-3808  Target:  5'-CGTGGACTTTCCGGAAATGATGGCAGA-3'    (SEQ ID NO: 413)

5'-AUGGCAGAGAUCAUCUCUGUGCAag-3'      (SEQ ID NO: 108)
                  3'-ACUACCGUCUCUAGUAGAGACACGUUC-5'    (SEQ ID NO: 261)

AR-3825  Target:  5'-TGATGGCAGAGATCATCTCTGTGCAAG-3'    (SEQ ID NO: 414)

5'-AGAGAUCAUCUCUGUGCAAGUGCcc-3'      (SEQ ID NO: 109)
                  3'-CGUCUCUAGUAGAGACACGUUCACGGG-5'    (SEQ ID NO: 262)

AR-3830  Target:  5'-GCAGAGATCATCTCTGTGCAAGTGCCC-3'    (SEQ ID NO: 415)

5'-GAGAUCAUCUCUGUGCAAGUGCCca-3'      (SEQ ID NO: 110)
                  3'-GUCUCUAGUAGAGACACGUUCACGGGU-5'    (SEQ ID NO: 263)

AR-3831  Target:  5'-CAGAGATCATCTCTGTGCAAGTGCCCA-3'    (SEQ ID NO: 416)

5'-CAAGAUCCUUUCUGGGAAAGUCAag-3'      (SEQ ID NO: 111)
                  3'-GGGUUCUAGGAAAGACCCUUUCAGUUC-5'    (SEQ ID NO: 264)

AR-3854  Target:  5'-CCCAAGATCCTTTCTGGGAAAGTCAAG-3'    (SEQ ID NO: 417)

5'-GAAGCAUUGGAAACCCUAUUUCCcc-3'      (SEQ ID NO: 112)
                  3'-CACUUCGUAACCUUUGGGAUAAAGGGG-5'    (SEQ ID NO: 265)

AR-3901  Target:  5'-GTGAAGCATTGGAAACCCTATTTCCCC-3'    (SEQ ID NO: 418)

5'-GAUGUCUUCUGCCUGUUAUAACUct-3'      (SEQ ID NO: 113)
                  3'-GUCUACAGAAGACGGACAAUAUUGAGA-5'    (SEQ ID NO: 266)

AR-3949  Target:  5'-CAGATGTCTTCTGCCTGTTATAACTCT-3'    (SEQ ID NO: 419)

5'-CUUGGGGAAUUUCCUCUAUUGAUgt-3'      (SEQ ID NO: 114)
                  3'-CGGAACCCCUUAAAGGAGAUAACUACA-5'    (SEQ ID NO: 267)

AR-3994  Target:  5'-GCCTTGGGGAATTTCCTCTATTGATGT-3'    (SEQ ID NO: 420)

5'-UGGGGAAUUUCCUCUAUUGAUGUac-3'      (SEQ ID NO: 115)
                  3'-GAACCCCUUAAAGGAGAUAACUACAUG-5'    (SEQ ID NO: 268)
```

TABLE 2-continued

Selected Anti-AR DsiRNA Agents

```
AR-3996 Target:  5'-CTTGGGGAATTTCCTCTATTGATGTAC-3'      (SEQ ID NO: 421)

5'-GGGGAAUUUCCUCUAUUGAUGUACa-3'       (SEQ ID NO: 116)
                 3'-AACCCCUUAAAGGAGAUAACUACAUGU-5'     (SEQ ID NO: 269)

AR-3997 Target:  5'-TTGGGGAATTTCCTCTATTGATGTACA-3'     (SEQ ID NO: 422)

5'-GGGAAUUUCCUCUAUUGAUGUACag-3'       (SEQ ID NO: 117)
                 3'-ACCCCUUAAAGGAGAUAACUACAUGUC-5'     (SEQ ID NO: 270)

AR-3998 Target:  5'-TGGGGAATTTCCTCTATTGATGTACAG-3'     (SEQ ID NO: 423)

5'-GGAAUUUCCUCUAUUGAUGUACAgt-3'       (SEQ ID NO: 118)
                 3'-CCCCUUAAAGGAGAUAACUACAUGUCA-5'     (SEQ ID NO: 271)

AR-3999 Target:  5'-GGGGAATTTCCTCTATTGATGTACAGT-3'     (SEQ ID NO: 424)

5'-AUUGAUGUACAGUCUGUCAUGAAca-3'       (SEQ ID NO: 119)
                 3'-GAUAACUACAUGUCAGACAGUACUUGU-5'     (SEQ ID NO: 272)

AR-4011 Target:  5'-CTATTGATGTACAGTCTGTCATGAACA-3'     (SEQ ID NO: 425)

5'-UUGAUGUACAGUCUGUCAUGAACat-3'       (SEQ ID NO: 120)
                 3'-AUAACUACAUGUCAGACAGUACUUGUA-5'     (SEQ ID NO: 273)

AR-4012 Target:  5'-TATTGATGTACAGTCTGTCATGAACAT-3'     (SEQ ID NO: 426)

5'-UGAUGUACAGUCUGUCAUGAACAtg-3'       (SEQ ID NO: 121)
                 3'-UAACUACAUGUCAGACAGUACUUGUAC-5'     (SEQ ID NO: 274)

AR-4013 Target:  5'-ATTGATGTACAGTCTGTCATGAACATG-3'     (SEQ ID NO: 427)

5'-CAUGUUCCUGAAUUCUAUUUGCUgg-3'       (SEQ ID NO: 122)
                 3'-UUGUACAAGGACUUAAGAUAAACGACC-5'     (SEQ ID NO: 275)

AR-4034 Target:  5'-AACATGTTCCTGAATTCTATTTGCTGG-3'     (SEQ ID NO: 428)

5'-CUAUUUGCUGGGCUUUUUUUUUCtc-3'       (SEQ ID NO: 123)
                 3'-AAGAUAAACGACCCGAAAAAAAAAGAG-5'     (SEQ ID NO: 276)

AR-4048 Target:  5'-TTCTATTTGCTGGGCTTTTTTTTCTC-3'      (SEQ ID NO: 429)

5'-UAUUUGCUGGGCUUUUUUUUUCUct-3'       (SEQ ID NO: 124)
                 3'-AGAUAAACGACCCGAAAAAAAAAGAGA-5'     (SEQ ID NO: 277)

AR-4049 Target:  5'-TCTATTTGCTGGGCTTTTTTTTCTCT-3'      (SEQ ID NO: 430)

5'-CUGGGCUUUUUUUUCUCUUUUCUct-3'       (SEQ ID NO: 125)
                 3'-ACGACCCGAAAAAAAAAGAGAAAAGAGA-5'    (SEQ ID NO: 278)

AR-4055 Target:  5'-TGCTGGGCTTTTTTTTCTCTTTCTCT-3'      (SEQ ID NO: 431)

5'-UUUUUUCUCUUUCUCUCCUUUUCUtt-3'      (SEQ ID NO: 126)
                 3'-AAAAAAAAGAGAAAGAGAGGAAAGAAA-5'     (SEQ ID NO: 279)

AR-4064 Target:  5'-TTTTTTTCTCTTTCTCTCCTTTCTTT-3'      (SEQ ID NO: 432)

5'-CAGACUUUGCUUCCCAUUGUGGCtc-3'       (SEQ ID NO: 127)
                 3'-AAGUCUGAAACGAAGGGUAACACCGAG-5'     (SEQ ID NO: 280)

AR-4128 Target:  5'-TTCAGACTTTGCTTCCCATTGTGGCTC-3'     (SEQ ID NO: 433)

5'-GUGGCUCCUAUCUGUGUUUUGAAtg-3'       (SEQ ID NO: 128)
                 3'-AACACCGAGGAUAGACACAAAACUUAC-5'     (SEQ ID NO: 281)

AR-4146 Target:  5'-TTGTGGCTCCTATCTGTGTTTTGAATG-3'     (SEQ ID NO: 434)

5'-CUAUCUGUGUUUUGAAUGGUGUUgt-3'       (SEQ ID NO: 129)
                 3'-AGGAUAGACACAAAACUUACCACAACA-5'     (SEQ ID NO: 282)

AR-4153 Target:  5'-TCCTATCTGTGTTTTGAATGGTGTTGT-3'     (SEQ ID NO: 435)

5'-CUGUGUUUUGAAUGGUGUUGUAUgc-3'       (SEQ ID NO: 130)
                 3'-UAGACACAAAACUUACCACAACAUACG-5'     (SEQ ID NO: 283)
```

TABLE 2-continued

Selected Anti-AR DsiRNA Agents

```
AR-4157  Target:  5'-ATCTGTGTTTTGAATGGTGTTGTATGC-3'      (SEQ ID NO: 436)

5'-UGUUUUGAAUGGUGUUGUAUGCCtt-3'        (SEQ ID NO: 131)
                  3'-ACACAAAACUUACCACAACAUACGGAA-5'      (SEQ ID NO: 284)

AR-4160  Target:  5'-TGTGTTTTGAATGGTGTTGTATGCCTT-3'      (SEQ ID NO: 437)

5'-AAUGGUGUUGUAUGCCUUUAAAUct-3'        (SEQ ID NO: 132)
                  3'-ACUUACCACAACAUACGGAAAUUUAGA-5'      (SEQ ID NO: 285)

AR-4167  Target:  5'-TGAATGGTGTTGTATGCCTTTAAATCT-3'      (SEQ ID NO: 438)

5'-AUGGUGUUGUAUGCCUUUAAAUCtg-3'        (SEQ ID NO: 133)
                  3'-CUUACCACAACAUACGGAAAUUUAGAC-5'      (SEQ ID NO: 286)

AR-4168  Target:  5'-GAATGGTGTTGTATGCCTTTAAATCTG-3'      (SEQ ID NO: 439)

5'-UUGUAUGCCUUUAAAUCUGUGAUga-3'        (SEQ ID NO: 134)
                  3'-ACAACAUACGGAAAUUUAGACACUACU-5'      (SEQ ID NO: 287)

AR-4174  Target:  5'-TGTTGTATGCCTTTAAATCTGTGATGA-3'      (SEQ ID NO: 440)

5'-GUAUGCCUUUAAAUCUGUGAUGAtc-3'        (SEQ ID NO: 135)
                  3'-AACAUACGGAAAUUUAGACACUACUAG-5'      (SEQ ID NO: 288)

AR-4176  Target:  5'-TTGTATGCCTTTAAATCTGTGATGATC-3'      (SEQ ID NO: 441)

5'-UAUGCCUUUAAAUCUGUGAUGAUcc-3'        (SEQ ID NO: 136)
                  3'-ACAUACGGAAAUUUAGACACUACUAGG-5'      (SEQ ID NO: 289)

AR-4177  Target:  5'-TGTATGCCTTTAAATCTGTGATGATCC-3'      (SEQ ID NO: 442)

5'-CAGUGUCAAGUUGUGCUUGUUUAca-3'        (SEQ ID NO: 137)
                  3'-GGGUCACAGUUCAACACGAACAAAUGU-5'      (SEQ ID NO: 290)

AR-4212  Target:  5'-CCCAGTGTCAAGTTGTGCTTGTTTACA-3'      (SEQ ID NO: 443)

5'-AGUGUCAAGUUGUGCUUGUUUACag-3'        (SEQ ID NO: 138)
                  3'-GGUCACAGUUCAACACGAACAAAUGUC-5'      (SEQ ID NO: 291)

AR-4213  Target:  5'-CCAGTGTCAAGTTGTGCTTGTTTACAG-3'      (SEQ ID NO: 444)

5'-UUGUUUACAGCACUACUCUGUGCca-3'        (SEQ ID NO: 139)
                  3'-CGAACAAAUGUCGUGAUGAGACACGGU-5'      (SEQ ID NO: 292)

AR-4228  Target:  5'-GCTTGTTTACAGCACTACTCTGTGCCA-3'      (SEQ ID NO: 445)

5'-UGUUUACAGCACUACUCUGUGCCag-3'        (SEQ ID NO: 140)
                  3'-GAACAAAUGUCGUGAUGAGACACGGUC-5'      (SEQ ID NO: 293)

AR-4229  Target:  5'-CTTGTTTACAGCACTACTCTGTGCCAG-3'      (SEQ ID NO: 446)

5'-CAAACGUUUACUUAUCUUAUGCCac-3'        (SEQ ID NO: 141)
                  3'-GUGUUUGCAAAUGAAUAGAAUACGGUG-5'      (SEQ ID NO: 294)

AR-4259  Target:  5'-CACAAACGTTTACTTATCTTATGCCAC-3'      (SEQ ID NO: 447)

5'-CGGGAAGUUUAGAGAGCUAAGAUta-3'        (SEQ ID NO: 142)
                  3'-GUGCCCUUCAAAUCUCUCGAUUCUAAU-5'      (SEQ ID NO: 295)

AR-4283  Target:  5'-CACGGGAAGTTTAGAGAGCTAAGATTA-3'      (SEQ ID NO: 448)

5'-GGGAAGUUUAGAGAGCUAAGAUUat-3'        (SEQ ID NO: 143)
                  3'-UGCCCUUCAAAUCUCUCGAUUCUAAUA-5'      (SEQ ID NO: 296)

AR-4284  Target:  5'-ACGGGAAGTTTAGAGAGCTAAGATTAT-3'      (SEQ ID NO: 449)

5'-GGAAGUUUAGAGAGCUAAGAUUAtc-3'        (SEQ ID NO: 144)
                  3'-GCCCUUCAAAUCUCUCGAUUCUAAUAG-5'      (SEQ ID NO: 297)

AR-4285  Target:  5'-CGGGAAGTTTAGAGAGCTAAGATTATC-3'      (SEQ ID NO: 450)

5'-GAAGUUUAGAGAGCUAAGAUUAUct-3'        (SEQ ID NO: 145)
                  3'-CCCUUCAAAUCUCUCGAUUCUAAUAGA-5'      (SEQ ID NO: 298)
```

TABLE 2-continued

Selected Anti-AR DsiRNA Agents

```
AR-4286 Target:  5'-GGGAAGTTTAGAGAGCTAAGATTATCT-3'    (SEQ ID NO: 451)

5'-AGUUUAGAGAGCUAAGAUUAUCUgg-3'     (SEQ ID NO: 146)
                 3'-CUUCAAAUCUCUCGAUUCUAAUAGACC-5'   (SEQ ID NO: 299)

AR-4288 Target:  5'-GAAGTTTAGAGAGCTAAGATTATCTGG-3'    (SEQ ID NO: 452)

5'-AGAGAGCUAAGAUUAUCUGGGGAaa-3'     (SEQ ID NO: 147)
                 3'-AAUCUCUCGAUUCUAAUAGACCCCUUU-5'   (SEQ ID NO: 300)

AR-4293 Target:  5'-TTAGAGAGCTAAGATTATCTGGGGAAA-3'    (SEQ ID NO: 453)

5'-GAGAGCUAAGAUUAUCUGGGGAAat-3'     (SEQ ID NO: 148)
                 3'-AUCUCUCGAUUCUAAUAGACCCCUUUA-5'   (SEQ ID NO: 301)

AR-4294 Target:  5'-TAGAGAGCTAAGATTATCTGGGGAAAT-3'    (SEQ ID NO: 454)

5'-AGAGCUAAGAUUAUCUGGGGAAAtc-3'     (SEQ ID NO: 149)
                 3'-UCUCUCGAUUCUAAUAGACCCCUUUAG-5'   (SEQ ID NO: 302)

AR-4295 Target:  5'-AGAGAGCTAAGATTATCTGGGGAAATC-3'    (SEQ ID NO: 455)

5'-AGAUUAUCUGGGGAAAUCAAAACaa-3'     (SEQ ID NO: 150)
                 3'-AUUCUAAUAGACCCCUUUAGUUUUGUU-5'   (SEQ ID NO: 303)

AR-4302 Target:  5'-TAAGATTATCTGGGGAAATCAAAACAA-3'    (SEQ ID NO: 456)

5'-GAUUAUCUGGGGAAAUCAAAACAaa-3'     (SEQ ID NO: 151)
                 3'-UUCUAAUAGACCCCUUUAGUUUUGUUU-5'   (SEQ ID NO: 304)

AR-4303 Target:  5'-AAGATTATCTGGGGAAATCAAAACAAA-3'    (SEQ ID NO: 457)

5'-CUGGGGAAAUCAAAACAAAAACAag-3'     (SEQ ID NO: 152)
                 3'-UAGACCCCUUUAGUUUUGUUUUUGUUC-5'   (SEQ ID NO: 305)

AR-4309 Target:  5'-ATCTGGGGAAATCAAAACAAAAACAAG-3'    (SEQ ID NO: 458)

5'-GGAAAUCAAAACAAAAACAAGCAaa-3'     (SEQ ID NO: 153)
                 3'-CCCCUUUAGUUUUGUUUUUGUUCGUUU-5'   (SEQ ID NO: 306)

AR-4313 Target:  5'-GGGGAAATCAAAACAAAAACAAGCAAA-3'    (SEQ ID NO: 459)

5'-GAAGUUUUUAAAAGCUGCUAAAGac-3'     (SEQ ID NO: 766)
                 3'-CACUUCAAAAAUUUUCGACGAUUUCUG-5'   (SEQ ID NO: 796)

AR-251 Target:   5'-GTGAAGTTTTTAAAAGCTGCTAAAGAC-3'    (SEQ ID NO: 826)

5'-CUAGCUGCACAUUGCAAAGAAGGct-3'     (SEQ ID NO: 767)
                 3'-UCGAUCGACGUGUAACGUUUCUUCCGA-5'   (SEQ ID NO: 797)

AR-524 Target:   5'-AGCTAGCTGCACATTGCAAAGAAGGCT-3'    (SEQ ID NO: 827)

5'-AUUGCAAAGAAGGCUCUUAGGAGcc-3'     (SEQ ID NO: 768)
                 3'-UGUAACGUUUCUUCCGAGAAUCCUCGG-5'   (SEQ ID NO: 798)

AR-534 Target:   5'-ACATTGCAAAGAAGGCTCTTAGGAGCC-3'    (SEQ ID NO: 828)

5'-CAAAACAAACAAAAACAAAAAAGcc-3'     (SEQ ID NO: 769)
                 3'-UUGUUUUGUUUGUUUUUGUUUUUUCGG-5'   (SEQ ID NO: 799)

AR-736 Target:   5'-AACAAAACAAACAAAAACAAAAAAGCC-3'    (SEQ ID NO: 829)

5'-GAUAAUAACUCAGUUCUUAUUUGca-3'     (SEQ ID NO: 770)
                 3'-UUCUAUUAUUGAGUCAAGAAUAAACGU-5'   (SEQ ID NO: 800)

AR-776 Target:   5'-AAGATAATAACTCAGTTCTTATTTGCA-3'    (SEQ ID NO: 830)

5'-CAGUGGACACUGAAUUUGGAAGGtg-3'     (SEQ ID NO: 771)
                 3'-AAGUCACCUGUGACUUAAACCUUCCAC-5'   (SEQ ID NO: 801)

AR-808 Target:   5'-TTCAGTGGACACTGAATTTGGAAGGTG-3'    (SEQ ID NO: 831)

5'-GUGGACACUGAAUUUGGAAGGUGga-3'     (SEQ ID NO: 772)
                 3'-GUCACCUGUGACUUAAACCUUCCACCU-5'   (SEQ ID NO: 802)
```

TABLE 2-continued

Selected Anti-AR DsiRNA Agents

| | | | |
|---|---|---|---|
| AR-810 Target: | 5'-CAGTGGACACTGAATTTGGAAGGTGGA-3' | (SEQ ID NO: 832) | |
| | 5'-UGGACACUGAAUUUGGAAGGUGGAg-3' | (SEQ ID NO: 773) | |
| | 3'-<u>UCA</u>CCUGUGACUUAAACCUUCCACCUC-5' | (SEQ ID NO: 803) | |
| AR-811 Target: | 5'-AGTGGACACTGAATTTGGAAGGTGGAG-3' | (SEQ ID NO: 833) | |
| | 5'-GAAUCUACCCUUCAAGUAUUAAGag-3' | (SEQ ID NO: 774) | |
| | 3'-<u>AAC</u>UUAGAUGGGAAGUUCAUAAUUCUC-5' | (SEQ ID NO: 804) | |
| AR-873 Target: | 5'-TTGAATCTACCCTTCAAGTATTAAGAG-3' | (SEQ ID NO: 834) | |
| | 5'-AGUAUUAAGAGACAGACUGUGAGcc-3' | (SEQ ID NO: 775) | |
| | 3'-<u>GUU</u>CAUAAUUCUCUGUCUGACACUCGG-5' | (SEQ ID NO: 805) | |
| AR-887 Target: | 5'-CAAGTATTAAGAGACAGACTGTGAGCC-3' | (SEQ ID NO: 835) | |
| | 5'-UGAGUAUUCCCCUUUCAAGGGAGGt-3' | (SEQ ID NO: 776) | |
| | 3'-<u>CGA</u>CUCAUAAGGGGAAAGUUCCCUCCA-5' | (SEQ ID NO: 806) | |
| AR-2060 Target: | 5'-GCTGAGTATTCCCCTTTCAAGGGAGGT-3' | (SEQ ID NO: 836) | |
| | 5'-GAGUAUUCCCCUUUCAAGGGAGGtt-3' | (SEQ ID NO: 777) | |
| | 3'-<u>GAC</u>UCAUAAGGGGAAAGUUCCCUCCAA-5' | (SEQ ID NO: 807) | |
| AR-2061 Target: | 5'-CTGAGTATTCCCCTTTCAAGGGAGGTT-3' | (SEQ ID NO: 837) | |
| | 5'-UGUGGAGAUGAAGCUUCUGGGUGtc-3' | (SEQ ID NO: 778) | |
| | 3'-<u>AGA</u>CACCUCUACUUCGAAGACCCACAG-5' | (SEQ ID NO: 808) | |
| AR-2826 Target: | 5'-TCTGTGGAGATGAAGCTTCTGGGTGTC-3' | (SEQ ID NO: 838) | |
| | 5'-AGGGAAACAGAAGUACCUGUGCGcc-3' | (SEQ ID NO: 779) | |
| | 3'-<u>CUU</u>CCCUUUGUCUUCAUGGACACGCGG-5' | (SEQ ID NO: 809) | |
| AR-2906 Target: | 5'-GAAGGGAAACAGAAGTACCTGTGCGCC-3' | (SEQ ID NO: 839) | |
| | 5'-GAUAAAUUCCGAAGGAAAAAUUGtc-3' | (SEQ ID NO: 780) | |
| | 3'-<u>AAC</u>UAUUUAAGGCUUCCUUUUUAACAG-5' | (SEQ ID NO: 810) | |
| AR-2952 Target: | 5'-TTGATAAATTCCGAAGGAAAAATTGTC-3' | (SEQ ID NO: 840) | |
| | 5'-AGGAAAAAUUGUCCAUCUUGUCGtc-3' | (SEQ ID NO: 781) | |
| | 3'-<u>CUU</u>CCUUUUUAACAGGUAGAACAGCAG-5' | (SEQ ID NO: 811) | |
| AR-2964 Target: | 5'-GAAGGAAAAATTGTCCATCTTGTCGTC-3' | (SEQ ID NO: 841) | |
| | 5'-GGAAAUGUUAUGAAGCAGGGAUGac-3' | (SEQ ID NO: 782) | |
| | 3'-<u>AGC</u>CUUUACAAUACUUCGUCCCUACUG-5' | (SEQ ID NO: 812) | |
| AR-2992 Target: | 5'-TCGGAAATGTTATGAAGCAGGGATGAC-3' | (SEQ ID NO: 842) | |
| | 5'-UUGGUAAUCUGAAACUACAGGAGga-3' | (SEQ ID NO: 783) | |
| | 3'-<u>UGA</u>ACCAUUAGACUUUGAUGUCCUCCU-5' | (SEQ ID NO: 813) | |
| AR-3043 Target: | 5'-ACTTGGTAATCTGAAACTACAGGAGGA-3' | (SEQ ID NO: 843) | |
| | 5'-UGGUAAUCUGAAACUACAGGAGGaa-3' | (SEQ ID NO: 784) | |
| | 3'-<u>GAA</u>CCAUUAGACUUUGAUGUCCUCCUU-5' | (SEQ ID NO: 814) | |
| AR-3044 Target: | 5'-CTTGGTAATCTGAAACTACAGGAGGAA-3' | (SEQ ID NO: 844) | |
| | 5'-UAAUCUGAAACUACAGGAGGAAGga-3' | (SEQ ID NO: 785) | |
| | 3'-<u>CCA</u>UUAGACUUUGAUGUCCUCCUUCCU-5' | (SEQ ID NO: 815) | |
| AR-3047 Target: | 5'-GGTAATCTGAAACTACAGGAGGAAGGA-3' | (SEQ ID NO: 845) | |
| | 5'-CUGACAGUGUCACACAUUGAAGGct-3' | (SEQ ID NO: 786) | |
| | 3'-<u>UCG</u>ACUGUCACAGUGUGUAACUUCCGA-5' | (SEQ ID NO: 816) | |
| AR-3117 Target: | 5'-AGCTGACAGTGTCACACATTGAAGGCT-3' | (SEQ ID NO: 846) | |
| | 5'-CUGUCAUUCAGUACUCCUGGAUGgg-3' | (SEQ ID NO: 787) | |
| | 3'-<u>CCG</u>ACAGUAAGUCAUGAGGACCUACCC-5' | (SEQ ID NO: 817) | |

TABLE 2-continued

Selected Anti-AR DsiRNA Agents

```
AR-3346  Target:  5'-GGCTGTCATTCAGTACTCCTGGATGGG-3'     (SEQ ID NO: 847)

5'-GAAAAAUCAAAAAUUCUUUGAUGAa-3'       (SEQ ID NO: 788)
                  3'-GACUUUUUAGUUUUUAAGAAACUACUU-5'     (SEQ ID NO: 818)

AR-3605  Target:  5'-CTGAAAAATCAAAAATTCTTTGATGAA-3'     (SEQ ID NO: 848)

5'-AAUUCUUUGAUGAACUUCGAAUGAa-3'       (SEQ ID NO: 789)
                  3'-UUUUAAGAAACUACUUGAAGCUUACUU-5'     (SEQ ID NO: 819)

AR-3616  Target:  5'-AAAATTCTTTGATGAACTTCGAATGAA-3'     (SEQ ID NO: 849)

5'-CUAAUCAAGUCACACAUGGUGAGCg-3'       (SEQ ID NO: 790)
                  3'-ACGAUUAGUUCAGUGUGUACCACUCGC-5'     (SEQ ID NO: 820)

AR-3783  Target:  5'-TGCTAATCAAGTCACACATGGTGAGCG-3'     (SEQ ID NO: 850)

5'-CGUGGACUUUCCGGAAAUGAUGGCa-3'       (SEQ ID NO: 791)
                  3'-UCGCACCUGAAAGGCCUUUACUACCGU-5'     (SEQ ID NO: 821)

AR-3806  Target:  5'-AGCGTGGACTTTCCGGAAATGATGGCA-3'     (SEQ ID NO: 851)

5'-UUGGGGAAUUUCCUCUAUUGAUGta-3'       (SEQ ID NO: 792)
                  3'-GGAACCCCUUAAAGGAGAUAACUACAU-5'     (SEQ ID NO: 822)

AR-3995  Target:  5'-CCTTGGGGAATTTCCTCTATTGATGTA-3'     (SEQ ID NO: 852)

5'-UGUGUUUUGAAUGGUGUUGUAUGcc-3'       (SEQ ID NO: 793)
                  3'-AGACACAAAACUUACCACAACAUACGG-5'     (SEQ ID NO: 823)

AR-4158  Target:  5'-TCTGTGTTTTGAATGGTGTTGTATGCC-3'     (SEQ ID NO: 853)

5'-UGUAUGCCUUUAAAUCUGUGAUGat-3'       (SEQ ID NO: 794)
                  3'-CAACAUACGGAAAUUUAGACACUACUA-5'     (SEQ ID NO: 824)

AR-4175  Target:  5'-GTTGTATGCCTTTAAATCTGTGATGAT-3'     (SEQ ID NO: 854)

5'-UAGAGAGCUAAGAUUAUCUGGGGaa-3'       (SEQ ID NO: 795)
                  3'-AAAUCUCUCGAUUCUAAUAGACCCCUU-5'     (SEQ ID NO: 825)

AR-4292  Target:  5'-TTTAGAGAGCTAAGATTATCTGGGGAA-3'     (SEQ ID NO: 855)

5'-GGUGAAGUUUUUAAAAGCUGCUAaa-3'       (SEQ ID NO: 916)
                  3'-AGCCACUUCAAAAAUUUUCGACGAUUU-5'     (SEQ ID NO: 970)

AR-248   Target:  5'-TCGGTGAAGTTTTTAAAAGCTGCTAAA-3'     (SEQ ID NO: 1024)

5'-UUUUUAAAAGCUGCUAAAGACUCgg-3'       (SEQ ID NO: 917)
                  3'-UCAAAAAUUUUCGACGAUUUCUGAGCC-5'     (SEQ ID NO: 971)

AR-255   Target:  5'-AGTTTTTAAAAGCTGCTAAAGACTCGG-3'     (SEQ ID NO: 1025)

5'-AGAGAGGUAACUCCCUUUGGCUGcg-3'       (SEQ ID NO: 918)
                  3'-CGUCUCUCCAUUGAGGGAAACCGACGC-5'     (SEQ ID NO: 972)

AR-489   Target:  5'-GCAGAGAGGTAACTCCCTTTGGCTGCG-3'     (SEQ ID NO: 1026)

5'-GAGAUCAAAAGAUGAAAAGGCAGtc-3'       (SEQ ID NO: 919)
                  3'-GUCUCUAGUUUUCUACUUUUCCGUCAG-5'     (SEQ ID NO: 973)

AR-690   Target:  5'-CAGAGATCAAAAGATGAAAAGGCAGTC-3'     (SEQ ID NO: 1027)

5'-AAAAACAAAACAAACAAAAACAAaa-3'       (SEQ ID NO: 920)
                  3'-GUUUUUUGUUUUGUUUGUUUUUGUUUU-5'     (SEQ ID NO: 974)

AR-731   Target:  5'-CAAAAACAAAACAAACAAAAACAAAA-3'      (SEQ ID NO: 1028)

5'-AUAAAAGAAAAAGAUAAUAACUCag-3'       (SEQ ID NO: 921)
                  3'-UUUAUUUUCUUUUUCUAUUAUUGAGUC-5'     (SEQ ID NO: 975)

AR-764   Target:  5'-AAATAAAAGAAAAAGATAATAACTCAG-3'     (SEQ ID NO: 1029)

5'-AAAAAGAUAAUAACUCAGUUCUUat-3'       (SEQ ID NO: 922)
                  3'-UCUUUUUCUAUUAUUGAGUCAAGAAUA-5'     (SEQ ID NO: 976)
```

TABLE 2-continued

Selected Anti-AR DsiRNA Agents

| | | | |
|---|---|---|---|
| AR-771 Target: | 5'-AGAAAAAGATAATAACTCAGTTCTTAT-3' | (SEQ ID NO: 1030) | |
| | 5'-AAUAACUCAGUUCUUAUUUGCACct-3' | (SEQ ID NO: 923) | |
| | 3'-UAUUAUUGAGUCAAGAAUAAACGUGGA-5' | (SEQ ID NO: 977) | |
| AR-779 Target: | 5'-ATAATAACTCAGTTCTTATTTGCACCT-3' | (SEQ ID NO: 1031) | |
| | 5'-GUGGAGGAUUUUGUUUUUUUCUUtt-3' | (SEQ ID NO: 924) | |
| | 3'-UCCACCUCCUAAAACAAAAAAGAAAA-5' | (SEQ ID NO: 978) | |
| AR-830 Target: | 5'-AGGTGGAGGATTTTGTTTTTTTCTTTT-3' | (SEQ ID NO: 1032) | |
| | 5'-UUGUUUUUUCUUUUAAGAUCUGgg-3' | (SEQ ID NO: 925) | |
| | 3'-AAACAAAAAAGAAAAUUCUAGACCC-5' | (SEQ ID NO: 979) | |
| AR-840 Target: | 5'-TTTTGTTTTTTTCTTTTAAGATCTGGG-3' | (SEQ ID NO: 1033) | |
| | 5'-UUUUUCUUUUAAGAUCUGGGCAUct-3' | (SEQ ID NO: 926) | |
| | 3'-AAAAAAGAAAAUUCUAGACCCGUAGA-5' | (SEQ ID NO: 980) | |
| AR-845 Target: | 5'-TTTTTTTCTTTTAAGATCTGGGCATCT-3' | (SEQ ID NO: 1034) | |
| | 5'-CUGGGCAUCUUUUGAAUCUACCCtt-3' | (SEQ ID NO: 927) | |
| | 3'-UAGACCCGUAGAAAACUUAGAUGGGAA-5' | (SEQ ID NO: 981) | |
| AR-860 Target: | 5'-ATCTGGGCATCTTTTGAATCTACCCTT-3' | (SEQ ID NO: 1035) | |
| | 5'-AGGGAAGUAGGUGGAAGAUUCAGcc-3' | (SEQ ID NO: 928) | |
| | 3'-AUUCCCUUCAUCCACCUUCUAAGUCGG-5' | (SEQ ID NO: 982) | |
| AR-1105 Target: | 5'-TAAGGGAAGTAGGTGGAAGATTCAGCC-3' | (SEQ ID NO: 1036) | |
| | 5'-GGAGCUUUCCAGAAUCUGUUCCAga-3' | (SEQ ID NO: 929) | |
| | 3'-CUCCUCGAAAGGUCUUAGACAAGGUCU-5' | (SEQ ID NO: 983) | |
| AR-1200 Target: | 5'-GAGGAGCTTTCCAGAATCTGTTCCAGA-3' | (SEQ ID NO: 1037) | |
| | 5'-CAGGAAGCAGUAUCCGAAGGCAGca-3' | (SEQ ID NO: 930) | |
| | 3'-UCGUCCUUCGUCAUAGGCUUCCGUCGU-5' | (SEQ ID NO: 984) | |
| AR-1734 Target: | 5'-AGCAGGAAGCAGTATCCGAAGGCAGCA-3' | (SEQ ID NO: 1038) | |
| | 5'-AAGGACAAUUACUUAGGGGGCACtt-3' | (SEQ ID NO: 931) | |
| | 3'-GGUUCCUGUUAAUGAAUCCCCCGUGAA-5' | (SEQ ID NO: 985) | |
| AR-1803 Target: | 5'-CCAAGGACAATTACTTAGGGGGCACTT-3' | (SEQ ID NO: 1039) | |
| | 5'-GGAGUUGUGUAAGGCAGUGUCGGtg-3' | (SEQ ID NO: 932) | |
| | 3'-UUCCUCAACACAUUCCGUCACAGCCAC-5' | (SEQ ID NO: 986) | |
| AR-1850 Target: | 5'-AAGGAGTTGTGTAAGGCAGTGTCGGTG-3' | (SEQ ID NO: 1040) | |
| | 5'-CAAGAGCACUGAAGAUACUGCUGag-3' | (SEQ ID NO: 933) | |
| | 3'-CCGUUCUCGUGACUUCUAUGACGACUC-5' | (SEQ ID NO: 987) | |
| AR-2039 Target: | 5'-GGCAAGAGCACTGAAGATACTGCTGAG-3' | (SEQ ID NO: 1041) | |
| | 5'-UGAAGAUACUGCUGAGUAUUCCCct-3' | (SEQ ID NO: 934) | |
| | 3'-UGACUUCUAUGACGACUCAUAAGGGGA-5' | (SEQ ID NO: 988) | |
| AR-2048 Target: | 5'-ACTGAAGATACTGCTGAGTATTCCCT-3' | (SEQ ID NO: 1042) | |
| | 5'-AGGGAGGUUACACCAAAGGGCUAga-3' | (SEQ ID NO: 935) | |
| | 3'-GUUCCCUCCAAUGUGGUUUCCCGAUCU-5' | (SEQ ID NO: 989) | |
| AR-2077 Target: | 5'-CAAGGGAGGTTACACCAAAGGGCTAGA-3' | (SEQ ID NO: 1043) | |
| | 5'-UGUGUCAAAAGCGAAAUGGGCCCct-3' | (SEQ ID NO: 936) | |
| | 3'-GAACACAGUUUUCGCUUUACCCGGGGA-5' | (SEQ ID NO: 990) | |
| AR-2694 Target: | 5'-CTTGTGTCAAAAGCGAAATGGGCCCCT-3' | (SEQ ID NO: 1044) | |
| | 5'-GUUUUGCCCAUUGACUAUUACUUtc-3' | (SEQ ID NO: 937) | |
| | 3'-UACAAAACGGGUAACUGAUAAUGAAAG-5' | (SEQ ID NO: 991) | |

TABLE 2-continued

Selected Anti-AR DsiRNA Agents

```
AR-2778 Target:  5'-ATGTTTTGCCCATTGACTATTACTTTC-3'  (SEQ ID NO: 1045)

5'-CAAGGUCUUCUUCAAAAGAGCCGct-3'   (SEQ ID NO: 938)
                 3'-ACGUUCCAGAAGAAGUUUUCUCGGCGA-5' (SEQ ID NO: 992)

AR-2879 Target:  5'-TGCAAGGTCTTCTTCAAAAGAGCCGCT-3'  (SEQ ID NO: 1046)

5'-GGGAAACAGAAGUACCUGUGCGCca-3'   (SEQ ID NO: 939)
                 3'-UUCCCUUUGUCUUCAUGGACACGCGGU-5' (SEQ ID NO: 993)

AR-2907 Target:  5'-AAGGGAAACAGAAGTACCTGTGCGCCA-3'  (SEQ ID NO: 1047)

5'-GAUUGCACUAUUGAUAAAUUCCGaa-3'   (SEQ ID NO: 940)
                 3'-UACUAACGUGAUAACUAUUUAAGGCUU-5' (SEQ ID NO: 994)

AR-2940 Target:  5'-ATGATTGCACTATTGATAAATTCCGAA-3'  (SEQ ID NO: 1048)

5'-AAUUCCGAAGGAAAAAUUGUCCAtc-3'   (SEQ ID NO: 941)
                 3'-AUUUAAGGCUUCCUUUUUAACAGGUAG-5' (SEQ ID NO: 995)

AR-2956 Target:  5'-TAAATTCCGAAGGAAAAATTGTCCATC-3'  (SEQ ID NO: 1049)

5'-GGAAAAAUUGUCCAUCUUGUCGUct-3'   (SEQ ID NO: 942)
                 3'-UUCCUUUUUAACAGGUAGAACAGCAGA-5' (SEQ ID NO: 996)

AR-2965 Target:  5'-AAGGAAAAATTGTCCATCTTGTCGTCT-3'  (SEQ ID NO: 1050)

5'-AAAAUUGUCCAUCUUGUCGUCUUcg-3'   (SEQ ID NO: 943)
                 3'-CUUUUUAACAGGUAGAACAGCAGAAGC-5' (SEQ ID NO: 997)

AR-2968 Target:  5'-GAAAAATTGTCCATCTTGTCGTCTTCG-3'  (SEQ ID NO: 1051)

5'-AGAAACUUGGUAAUCUGAAACUAca-3'   (SEQ ID NO: 944)
                 3'-CUUCUUUGAACCAUUAGACUUUGAUGU-5' (SEQ ID NO: 998)

AR-3037 Target:  5'-GAAGAAACTTGGTAATCTGAAACTACA-3'  (SEQ ID NO: 1052)

5'-UUGAAGGCUAUGAAUGUCAGCCCat-3'   (SEQ ID NO: 945)
                 3'-GUAACUUCCGAUACUUACAGUCGGGUA-5' (SEQ ID NO: 999)

AR-3133 Target:  5'-CATTGAAGGCTATGAATGTCAGCCCAT-3'  (SEQ ID NO: 1053)

5'-GGAAUUCCUGUGCAUGAAAGCACtg-3'   (SEQ ID NO: 946)
                 3'-GUCCUUAAGGACACGUACUUUCGUGAC-5' (SEQ ID NO: 1000)

AR-3548 Target:  5'-CAGGAATTCCTGTGCATGAAAGCACTG-3'  (SEQ ID NO: 1054)

5'-AAAAAUUCUUUGAUGAACUUCGAat-3'   (SEQ ID NO: 947)
                 3'-AGUUUUUAAGAAACUACUUGAAGCUUA-5' (SEQ ID NO: 1001)

AR-3613 Target:  5'-TCAAAAATTCTTTGATGAACTTCGAAT-3'  (SEQ ID NO: 1055)

5'-UUUGAUGAACUUCGAAUGAACUAca-3'   (SEQ ID NO: 948)
                 3'-AGAAACUACUUGAAGCUUACUUGAUGU-5' (SEQ ID NO: 1002)

AR-3621 Target:  5'-TCTTTGATGAACTTCGAATGAACTACA-3'  (SEQ ID NO: 1056)

5'-GAUGAACUUCGAAUGAACUACAUca-3'   (SEQ ID NO: 949)
                 3'-AACUACUUGAAGCUUACUUGAUGUAGU-5' (SEQ ID NO: 1003)

AR-3624 Target:  5'-TTGATGAACTTCGAATGAACTACATCA-3'  (SEQ ID NO: 1057)

5'-GAAUGAACUACAUCAAGGAACUCga-3'   (SEQ ID NO: 950)
                 3'-AGCUUACUUGAUGUAGUUCCUUGAGCU-5' (SEQ ID NO: 1004)

AR-3634 Target:  5'-TCGAATGAACTACATCAAGGAACTCGA-3'  (SEQ ID NO: 1058)

5'-CAAAAGAAAAAAUCCCACAUCCUGc-3'   (SEQ ID NO: 951)
                 3'-ACGUUUUCUUUUUUAGGGUGUAGGACG-5' (SEQ ID NO: 1005)

AR-3674 Target:  5'-TGCAAAAGAAAAAATCCCACATCCTGC-3'  (SEQ ID NO: 1059)

5'-AGAAAAAAUCCCACAUCCUGCUCaa-3'   (SEQ ID NO: 952)
                 3'-UUUCUUUUUUAGGGUGUAGGACGAGUU-5' (SEQ ID NO: 1006)
```

TABLE 2-continued

Selected Anti-AR DsiRNA Agents

```
AR-3678 Target:  5'-AAAGAAAAAATCCCACATCCTGCTCAA-3'      (SEQ ID NO: 1060)

5'-UUUUGACCUGCUAAUCAAGUCACac-3'       (SEQ ID NO: 953)
                 3'-UGAAAACUGGACGAUUAGUUCAGUGUG-5'     (SEQ ID NO: 1007)

AR-3773 Target:  5'-ACTTTTGACCTGCTAATCAAGTCACAC-3'     (SEQ ID NO: 1061)

5'-AAGAUCCUUUCUGGGAAAGUCAAgc-3'       (SEQ ID NO: 954)
                 3'-GGUUCUAGGAAAGACCCUUUCAGUUCG-5'     (SEQ ID NO: 1008)

AR-3855 Target:  5'-CCAAGATCCTTTCTGGGAAAGTCAAGC-3'     (SEQ ID NO: 1062)

5'-AAAGUCAAGCCCAUCUAUUUCCAca-3'       (SEQ ID NO: 955)
                 3'-CCUUUCAGUUCGGGUAGAUAAAGGUGU-5'     (SEQ ID NO: 1009)

AR-3870 Target:  5'-GGAAAGTCAAGCCCATCTATTTCCACA-3'     (SEQ ID NO: 1063)

5'-AUGUCUUCUGCCUGUUAUAACUCUg-3'       (SEQ ID NO: 956)
                 3'-UCUACAGAAGACGGACAAUAUUGAGAC-5'    (SEQ ID NO: 1010)

AR-3950 Target:  5'-AGATGTCTTCTGCCTGTTATAACTCTG-3'     (SEQ ID NO: 1064)

5'-GAAUUUCCUCUAUUGAUGUACAGtc-3'       (SEQ ID NO: 957)
                 3'-CCCUUAAAGGAGAUAACUACAUGUCAG-5'     (SEQ ID NO: 1011)

AR-4000 Target:  5'-GGGAATTTCCTCTATTGATGTACAGTC-3'     (SEQ ID NO: 1065)

5'-GAUGUACAGUCUGUCAUGAACAUgt-3'       (SEQ ID NO: 958)
                 3'-AACUACAUGUCAGACAGUACUUGUACA-5'    (SEQ ID NO: 1012)

AR-4014 Target:  5'-TTGATGTACAGTCTGTCATGAACATGT-3'     (SEQ ID NO: 1066)

5'-CAGUCUGUCAUGAACAUGUUCCUga-3'       (SEQ ID NO: 959)
                 3'-AUGUCAGACAGUACUUGUACAAGGACU-5'     (SEQ ID NO: 1013)

AR-4020 Target:  5'-TACAGTCTGTCATGAACATGTTCCTGA-3'     (SEQ ID NO: 1067)

5'-CAUGAACAUGUUCCUGAAUUCUAtt-3'       (SEQ ID NO: 960)
                 3'-CAGUACUUGUACAAGGACUUAAGAUAA-5'     (SEQ ID NO: 1014)

AR-4028 Target:  5'-GTCATGAACATGTTCCTGAATTCTATT-3'     (SEQ ID NO: 1068)

5'-AUGUUCCUGAAUUCUAUUUGCUGgg-3'       (SEQ ID NO: 961)
                 3'-UGUACAAGGACUUAAGAUAAACGACCC-5'     (SEQ ID NO: 1015)

AR-4035 Target:  5'-ACATGTTCCTGAATTCTATTTGCTGGG-3'     (SEQ ID NO: 1069)

5'-UGGGCUUUUUUUUCUCUUUCUCtc-3'        (SEQ ID NO: 962)
                 3'-CGACCCGAAAAAAAAGAGAAAGAGAG-5'      (SEQ ID NO: 1016)

AR-4056 Target:  5'-GCTGGGCTTTTTTTTCTCTTTCTCTC-3'      (SEQ ID NO: 1070)

5'-UUUUUCUCUUUCUCUCCUUUCUUtt-3'       (SEQ ID NO: 963)
                 3'-AAAAAAGAGAAAGAGAGGAAAGAAAA-5'      (SEQ ID NO: 1017)

AR-4065 Target:  5'-TTTTTTTCTCTTTCTCTCCTTTCTTTT-3'     (SEQ ID NO: 1071)

5'-GUUUUGAAUGGUGUUGUAUGCCUtt-3'       (SEQ ID NO: 964)
                 3'-CACAAAACUUACCACAACAUACGGAAA-5'     (SEQ ID NO: 1018)

AR-4161 Target:  5'-GTGTTTTGAATGGTGTTGTATGCCTTT-3'     (SEQ ID NO: 1072)

5'-GGUGUUGUAUGCCUUUAAAUCUGtg-3'       (SEQ ID NO: 965)
                 3'-UACCACAACAUACGGAAAUUUAGACAC-5'     (SEQ ID NO: 1019)

AR-4170 Target:  5'-ATGGTGTTGTATGCCTTTAAATCTGTG-3'     (SEQ ID NO: 1073)

5'-CAAGUUGUGCUUGUUUACAGCACta-3'       (SEQ ID NO: 966)
                 3'-CAGUUCAACACGAACAAAUGUCGUGAU-5'     (SEQ ID NO: 1020)

AR-4218 Target:  5'-GTCAAGTTGTGCTTGTTACAGCACTA-3'      (SEQ ID NO: 1074)

5'-CUAAGAUUAUCUGGGGAAAUCAAaa-3'       (SEQ ID NO: 967)
                 3'-UCGAUUCUAAUAGACCCCUUUAGUUUU-5'     (SEQ ID NO: 1021)
```

TABLE 2-continued

Selected Anti-AR DsiRNA Agents

```
AR-4299 Target:  5'-AGCTAAGATTATCTGGGGAAATCAAAA-3'       (SEQ ID NO: 1075)

5'-UGGGGAAAUCAAAACAAAAACAAgc-3'         (SEQ ID NO: 968)
                 3'-AGACCCCUUUAGUUUUGUUUUUGUUCG-5'       (SEQ ID NO: 1022)

AR-4310 Target:  5'-TCTGGGGAAATCAAAACAAAAACAAGC-3'       (SEQ ID NO: 1076)

5'-GAAAUCAAAACAAAAACAAGCAAac-3'         (SEQ ID NO: 969)
                 3'-CCCUUUAGUUUUGUUUUUGUUCGUUUG-5'       (SEQ ID NO: 1023)

AR-4314 Target:  5'-GGGAAATCAAAACAAAAACAAGCAAAC-3'       (SEQ ID NO: 1077)

5'-GUGAAGUUUUUAAAAGCUGCUAAag-3'         (SEQ ID NO: 1186)
                 3'-GCCACUUCAAAAAUUUUCGACGAUUUC-5'       (SEQ ID NO: 1249)

AR-249 Target:   5'-CGGTGAAGTTTTTAAAAGCTGCTAAAG-3'       (SEQ ID NO: 1312)

5'-UUUUAAAAGCUGCUAAAGACUCGga-3'         (SEQ ID NO: 1187)
                 3'-CAAAAAUUUUCGACGAUUUCUGAGCCU-5'       (SEQ ID NO: 1250)

AR-256 Target:   5'-GTTTTTAAAAGCTGCTAAAGACTCGGA-3'       (SEQ ID NO: 1313)

5'-UUAAAAGCUGCUAAAGACUCGGAgg-3'         (SEQ ID NO: 1188)
                 3'-AAAAUUUUCGACGAUUUCUGAGCCUCC-5'       (SEQ ID NO: 1251)

AR-258 Target:   5'-TTTTAAAAGCTGCTAAAGACTCGGAGG-3'       (SEQ ID NO: 1314)

5'-GGAGAGAACCCUCUGUUUUCCCCca-3'         (SEQ ID NO: 1189)
                 3'-CGCCUCUCUUGGGAGACAAAAGGGGGU-5'       (SEQ ID NO: 1252)

AR-618 Target:   5'-GCGGAGAGAACCCTCTGTTTTCCCCCA-3'       (SEQ ID NO: 1315)

5'-AGAUCAAAAGAUGAAAAGGCAGUca-3'         (SEQ ID NO: 1190)
                 3'-UCUCUAGUUUUCUACUUUUCCGUCAGU-5'       (SEQ ID NO: 1253)

AR-691 Target:   5'-AGAGATCAAAAGATGAAAAGGCAGTCA-3'       (SEQ ID NO: 1316)

5'-CAAAAGAUGAAAAGGCAGUCAGGtc-3'         (SEQ ID NO: 1191)
                 3'-UAGUUUUCUACUUUUCCGUCAGUCCAG-5'       (SEQ ID NO: 1254)

AR-695 Target:   5'-ATCAAAAGATGAAAAGGCAGTCAGGTC-3'       (SEQ ID NO: 1317)

5'-CAGUAGCCAAAAAACAAAACAAAca-3'         (SEQ ID NO: 1192)
                 3'-AAGUCAUCGGUUUUUUGUUUUGUUUGU-5'       (SEQ ID NO: 1255)

AR-722 Target:   5'-TTCAGTAGCCAAAAAACAAAACAAACA-3'       (SEQ ID NO: 1318)

5'-AAAACAAAACAAACAAAAACAAAaa-3'         (SEQ ID NO: 1193)
                 3'-UUUUUUGUUUUGUUUGUUUUUGUUUUU-5'       (SEQ ID NO: 1256)

AR-732 Target:   5'-AAAAAACAAAACAAACAAAAACAAAA-3'        (SEQ ID NO: 1319)

5'-UAAAAGAAAAGAUAAUAACUCAgt-3'          (SEQ ID NO: 1194)
                 3'-UUAUUUUCUUUUUCUAUUAUUGAGUCA-5'       (SEQ ID NO: 1257)

AR-765 Target:   5'-AATAAAAGAAAAGATAATAACTCAGT-3'        (SEQ ID NO: 1320)

5'-AAAGAAAAGAUAAUAACUCAGUtc-3'          (SEQ ID NO: 1195)
                 3'-AUUUUCUUUUCUAUUAUUGAGUCAAG-5'        (SEQ ID NO: 1258)

AR-767 Target:   5'-TAAAAGAAAAGATAATAACTCAGTTC-3'        (SEQ ID NO: 1321)

5'-AAAAGAUAAUAACUCAGUUCUUAtt-3'         (SEQ ID NO: 1196)
                 3'-CUUUUUCUAUUAUUGAGUCAAGAAUAA-5'       (SEQ ID NO: 1259)

AR-772 Target:   5'-GAAAAGATAATAACTCAGTTCTTATT-3'        (SEQ ID NO: 1322)

5'-AUAACUCAGUUCUUAUUUGCACCta-3'         (SEQ ID NO: 1197)
                 3'-AUUAUUGAGUCAAGAAUAAACGUGGAU-5'       (SEQ ID NO: 1260)

AR-780 Target:   5'-TAATAACTCAGTTCTTATTTGCACCTA-3'       (SEQ ID NO: 1323)

5'-CAGUUCUUAUUUGCACCUACUUCag-3'         (SEQ ID NO: 1198)
                 3'-GAGUCAAGAAUAAACGUGGAUGAAGUC-5'       (SEQ ID NO: 1261)
```

TABLE 2-continued

Selected Anti-AR DsiRNA Agents

```
AR-786 Target:    5'-CTCAGTTCTTATTTGCACCTACTTCAG-3'   (SEQ ID NO: 1324)

5'-UGGAGGAUUUUGUUUUUUUCUUUta-3'     (SEQ ID NO: 1199)
                  3'-CCACCUCCUAAAACAAAAAAAGAAAAU-5'   (SEQ ID NO: 1262)

AR-831 Target:    5'-GGTGGAGGATTTTGTTTTTTCTTTTA-3'    (SEQ ID NO: 1325)

5'-UGUUUUUUUCUUUUAAGAUCUGGgc-3'     (SEQ ID NO: 1200)
                  3'-AAACAAAAAAGAAAAUUCUAGACCCG-5'    (SEQ ID NO: 1263)

AR-841 Target:    5'-TTTGTTTTTTTCTTTTAAGATCTGGGC-3'   (SEQ ID NO: 1326)

5'-UUUUCUUUUAAGAUCUGGGCAUCtt-3'     (SEQ ID NO: 1201)
                  3'-AAAAAGAAAAUUCUAGACCCGUAGAA-5'    (SEQ ID NO: 1264)

AR-846 Target:    5'-TTTTTTCTTTTAAGATCTGGGCATCTT-3'   (SEQ ID NO: 1327)

5'-UGGGCAUCUUUUGAAUCUACCCUtc-3'     (SEQ ID NO: 1202)
                  3'-AGACCCGUAGAAAACUUAGAUGGGAAG-5'   (SEQ ID NO: 1265)

AR-861 Target:    5'-TCTGGGCATCTTTTGAATCTACCCTTC-3'   (SEQ ID NO: 1328)

5'-CAAGUUUCCUUCUCUGGAGCUUCcc-3'     (SEQ ID NO: 1203)
                  3'-GCGUUCAAAGGAAGAGACCUCGAAGGG-5'   (SEQ ID NO: 1266)

AR-997 Target:    5'-CGCAAGTTTCCTTCTCTGGAGCTTCCC-3'   (SEQ ID NO: 1329)

5'-GGGAAGUAGGUGGAAGAUUCAGCca-3'     (SEQ ID NO: 1204)
                  3'-UUCCCUUCAUCCACCUUCUAAGUCGGU-5'   (SEQ ID NO: 1267)

AR-1106 Target:   5'-AAGGGAAGTAGGTGGAAGATTCAGCCA-3'   (SEQ ID NO: 1330)

5'-AAGUAGGUGGAAGAUUCAGCCAAgc-3'     (SEQ ID NO: 1205)
                  3'-CCUUCAUCCACCUUCUAAGUCGGUUCG-5'   (SEQ ID NO: 1268)

AR-1109 Target:   5'-GGAAGTAGGTGGAAGATTCAGCCAAGC-3'   (SEQ ID NO: 1331)

5'-AGGACAAUUACUUAGGGGGCACUtc-3'     (SEQ ID NO: 1206)
                  3'-GUUCCUGUUAAUGAAUCCCCCGUGAAG-5'   (SEQ ID NO: 1269)

AR-1804 Target:   5'-CAAGGACAATTACTTAGGGGGCACTTC-3'   (SEQ ID NO: 1332)

5'-CGAAUGCAAAGGUUCUCUGCUAGac-3'     (SEQ ID NO: 1207)
                  3'-CGGCUUACGUUUCCAAGAGACGAUCUG-5'   (SEQ ID NO: 1270)

AR-2003 Target:   5'-GCCGAATGCAAAGGTTCTCTGCTAGAC-3'   (SEQ ID NO: 1333)

5'-AAGAGCACUGAAGAUACUGCUGAgt-3'     (SEQ ID NO: 1208)
                  3'-CGUUCUCGUGACUUCUAUGACGACUCA-5'   (SEQ ID NO: 1271)

AR-2040 Target:   5'-GCAAGAGCACTGAAGATACTGCTGAGT-3'   (SEQ ID NO: 1334)

5'-GAAGAUACUGCUGAGUAUUCCCCtt-3'     (SEQ ID NO: 1209)
                  3'-GACUUCUAUGACGACUCAUAAGGGGAA-5'   (SEQ ID NO: 1272)

AR-2049 Target:   5'-CTGAAGATACTGCTGAGTATTCCCCTT-3'   (SEQ ID NO: 1335)

5'-GUGUCAAAAGCGAAAUGGGCCCCtg-3'     (SEQ ID NO: 1210)
                  3'-AACACAGUUUUCGCUUUACCCGGGGAC-5'   (SEQ ID NO: 1273)

AR-2695 Target:   5'-TTGTGTCAAAAGCGAAATGGGCCCCTG-3'   (SEQ ID NO: 1336)

5'-UUUUGCCCAUUGACUAUUACUUUcc-3'     (SEQ ID NO: 1211)
                  3'-ACAAAACGGGUAACUGAUAAUGAAAGG-5'   (SEQ ID NO: 1274)

AR-2779 Target:   5'-TGTTTTGCCCATTGACTATTACTTTCC-3'   (SEQ ID NO: 1337)

5'-CAUUGACUAUUACUUUCCACCCCag-3'     (SEQ ID NO: 1212)
                  3'-GGGUAACUGAUAAUGAAAGGUGGGGUC-5'   (SEQ ID NO: 1275)

AR-2786 Target:   5'-CCCATTGACTATTACTTTCCACCCCAG-3'   (SEQ ID NO: 1338)

5'-AAGGUCUUCUUCAAAAGAGCCGCtg-3'     (SEQ ID NO: 1213)
                  3'-CGUUCCAGAAGAAGUUUUCUCGGCGAC-5'   (SEQ ID NO: 1276)
```

TABLE 2-continued

Selected Anti-AR DsiRNA Agents

```
AR-2880 Target:  5'-GCAAGGTCTTCTTCAAAAGAGCCGCTG-3'   (SEQ ID NO: 1339)

5'-AUUGCACUAUUGAUAAAUUCCGAag-3'    (SEQ ID NO: 1214)
                 3'-ACUAACGUGAUAACUAUUUAAGGCUUC-5'  (SEQ ID NO: 1277)

AR-2941 Target:  5'-TGATTGCACTATTGATAAATTCCGAAG-3'   (SEQ ID NO: 1340)

5'-CGAAGGAAAAAUUGUCCAUCUUGtc-3'    (SEQ ID NO: 1215)
                 3'-AGGCUUCCUUUUUAACAGGUAGAACAG-5'  (SEQ ID NO: 1278)

AR-2961 Target:  5'-TCCGAAGGAAAAATTGTCCATCTTGTC-3'   (SEQ ID NO: 1341)

5'-GAAAAAUUGUCCAUCUUGUCGUCtt-3'    (SEQ ID NO: 1216)
                 3'-UCCUUUUUAACAGGUAGAACAGCAGAA-5'  (SEQ ID NO: 1279)

AR-2966 Target:  5'-AGGAAAAATTGTCCATCTTGTCGTCTT-3'   (SEQ ID NO: 1342)

5'-CAGUGUCACACAUUGAAGGCUAUga-3'    (SEQ ID NO: 1217)
                 3'-CUGUCACAGUGUGUAACUUCCGAUACU-5'  (SEQ ID NO: 1280)

AR-3121 Target:  5'-GACAGTGTCACACATTGAAGGCTATGA-3'   (SEQ ID NO: 1343)

5'-UGAAGGCUAUGAAUGUCAGCCCAtc-3'    (SEQ ID NO: 1218)
                 3'-UAACUUCCGAUACUUACAGUCGGGUAG-5'  (SEQ ID NO: 1281)

AR-3134 Target:  5'-ATTGAAGGCTATGAATGTCAGCCCATC-3'   (SEQ ID NO: 1344)

5'-AUGGCUGUCAUUCAGUACUCCUGga-3'    (SEQ ID NO: 1219)
                 3'-UCUACCGACAGUAAGUCAUGAGGACCU-5'  (SEQ ID NO: 1282)

AR-3342 Target:  5'-AGATGGCTGTCATTCAGTACTCCTGGA-3'   (SEQ ID NO: 1345)

5'-UGGUUUUCAAUGAGUACCGCAUGca-3'    (SEQ ID NO: 1220)
                 3'-AGACCAAAAGUUACUCAUGGCGUACGU-5'  (SEQ ID NO: 1283)

AR-3445 Target:  5'-TCTGGTTTTCAATGAGTACCGCATGCA-3'   (SEQ ID NO: 1346)

5'-GAAUUCCUGUGCAUGAAAGCACUgc-3'    (SEQ ID NO: 1221)
                 3'-UCCUUAAGGACACGUACUUUCGUGACG-5'  (SEQ ID NO: 1284)

AR-3549 Target:  5'-AGGAATTCCTGTGCATGAAAGCACTGC-3'   (SEQ ID NO: 1347)

5'-AAAAUUCUUUGAUGAACUUCGAAtg-3'    (SEQ ID NO: 1222)
                 3'-GUUUUUAAGAAACUACUUGAAGCUUAC-5'  (SEQ ID NO: 1285)

AR-3614 Target:  5'-CAAAAATTCTTTGATGAACTTCGAATG-3'   (SEQ ID NO: 1348)

5'-UUGAUGAACUUCGAAUGAACUACat-3'    (SEQ ID NO: 1223)
                 3'-GAAACUACUUGAAGCUUACUUGAUGUA-5'  (SEQ ID NO: 1286)

AR-3622 Target:  5'-CTTTGATGAACTTCGAATGAACTACAT-3'   (SEQ ID NO: 1349)

5'-AUGAACUUCGAAUGAACUACAUCaa-3'    (SEQ ID NO: 1224)
                 3'-ACUACUUGAAGCUUACUUGAUGUAGUU-5'  (SEQ ID NO: 1287)

AR-3625 Target:  5'-TGATGAACTTCGAATGAACTACATCAA-3'   (SEQ ID NO: 1350)

5'-AAUGAACUACAUCAAGGAACUCGat-3'    (SEQ ID NO: 1225)
                 3'-GCUUACUUGAUGUAGUUCCUUGAGCUA-5'  (SEQ ID NO: 1288)

AR-3635 Target:  5'-CGAATGAACTACATCAAGGAACTCGAT-3'   (SEQ ID NO: 1351)

5'-UGAACUACAUCAAGGAACUCGAUcg-3'    (SEQ ID NO: 1226)
                 3'-UUACUUGAUGUAGUUCCUUGAGCUAGC-5'  (SEQ ID NO: 1289)

AR-3637 Target:  5'-AATGAACTACATCAAGGAACTCGATCG-3'   (SEQ ID NO: 1352)

5'-AAAAGAAAAAAUCCCACAUCCUGct-3'    (SEQ ID NO: 1227)
                 3'-CGUUUUCUUUUUUAGGGUGUAGGACGA-5'  (SEQ ID NO: 1290)

AR-3675 Target:  5'-GCAAAAGAAAAAATCCCACATCCTGCT-3'   (SEQ ID NO: 1353)

5'-GAAAAAAUCCCACAUCCUGCUCAag-3'    (SEQ ID NO: 1228)
                 3'-UUCUUUUUUAGGGUGUAGGACGAGUUC-5'  (SEQ ID NO: 1291)
```

TABLE 2-continued

Selected Anti-AR DsiRNA Agents

```
AR-3679  Target:  5'-AAGAAAAAATCCCACATCCTGCTCAAG-3'    (SEQ ID NO: 1354)

5'-UUUGACCUGCUAAUCAAGUCACAca-3'      (SEQ ID NO: 1229)
                  3'-GAAACUGGACGAUUAGUUCAGUGUGU-5'     (SEQ ID NO: 1292)

AR-3774  Target:  5'-CTTTTGACCTGCTAATCAAGTCACACA-3'    (SEQ ID NO: 1355)

5'-CUGUUAUAACUCUGCACUACUCCtc-3'      (SEQ ID NO: 1230)
                  3'-CGGACAAUAUUGAGACGUGAUGAGGAG-5'    (SEQ ID NO: 1293)

AR-3961  Target:  5'-GCCTGTTATAACTCTGCACTACTCCTC-3'    (SEQ ID NO: 1356)

5'-GUUAUAACUCUGCACUACUCCUCtg-3'      (SEQ ID NO: 1231)
                  3'-GACAAUAUUGAGACGUGAUGAGGAGAC-5'    (SEQ ID NO: 1294)

AR-3963  Target:  5'-CTGTTATAACTCTGCACTACTCCTCTG-3'    (SEQ ID NO: 1357)

5'-AAUUCCUCUAUUGAUGUACAGUct-3'       (SEQ ID NO: 1232)
                  3'-CCUUAAAGGAGAUAACUACAUGUCAGA-5'    (SEQ ID NO: 1295)

AR-4001  Target:  5'-GGAATTTCCTCTATTGATGTACAGTCT-3'    (SEQ ID NO: 1358)

5'-CUAUUGAUGUACAGUCUGUCAUGaa-3'      (SEQ ID NO: 1233)
                  3'-GAGAUAACUACAUGUCAGACAGUACUU-5'    (SEQ ID NO: 1296)

AR-4009  Target:  5'-CTCTATTGATGTACAGTCTGTCATGAA-3'    (SEQ ID NO: 1359)

5'-AUGAACAUGUUCCUGAAUUCUAUtt-3'      (SEQ ID NO: 1234)
                  3'-AGUACUUGUACAAGGACUUAAGAUAAA-5'    (SEQ ID NO: 1297)

AR-4029  Target:  5'-TCATGAACATGTTCCTGAATTCTATTT-3'    (SEQ ID NO: 1360)

5'-CUGAAUUCUAUUUGCUGGGCUUUtt-3'      (SEQ ID NO: 1235)
                  3'-AGGACUUAAGAUAAACGACCCGAAAAA-5'    (SEQ ID NO: 1298)

AR-4041  Target:  5'-TCCTGAATTCTATTTGCTGGGCTTTTT-3'    (SEQ ID NO: 1361)

5'-UUUUUUUUUCUCUUUCUCUCCUUtc-3'      (SEQ ID NO: 1236)
                  3'-CGAAAAAAAAAGAGAAAGAGAGGAAAG-5'    (SEQ ID NO: 1299)

AR-4061  Target:  5'-GCTTTTTTTTCTCTTTCTCTCCTTTC-3'     (SEQ ID NO: 1362)

5'-UUUUCUCUUUCUCUCCUUUCUUUtt-3'      (SEQ ID NO: 1237)
                  3'-AAAAAGAGAAAGAGAGGAAAGAAAAA-5'     (SEQ ID NO: 1300)

AR-4066  Target:  5'-TTTTTTCTCTTTCTCTCCTTTCTTTTT-3'    (SEQ ID NO: 1363)

5'-CUUUCUCUCCUUUCUUUUUCUUCtt-3'      (SEQ ID NO: 1238)
                  3'-GAGAAAGAGAGGAAAGAAAAAGAAGAA-5'    (SEQ ID NO: 1301)

AR-4072  Target:  5'-CTCTTTCTCTCCTTTCTTTTTCTTCTT-3'    (SEQ ID NO: 1364)

5'-AUGGCACCUUCAGACUUUGCUUCcc-3'      (SEQ ID NO: 1239)
                  3'-GGUACCGUGGAAGUCUGAAACGAAGGG-5'    (SEQ ID NO: 1302)

AR-4118  Target:  5'-CCATGGCACCTTCAGACTTTGCTTCCC-3'    (SEQ ID NO: 1365)

5'-UUUUGAAUGGUGUUGUAUGCCUUta-3'      (SEQ ID NO: 1240)
                  3'-ACAAAACUUACCACAACAUACGGAAAU-5'    (SEQ ID NO: 1303)

AR-4162  Target:  5'-TGTTTTGAATGGTGTTGTATGCCTTTA-3'    (SEQ ID NO: 1366)

5'-GUGUUGUAUGCCUUUAAAUCUGUga-3'      (SEQ ID NO: 1241)
                  3'-ACCACAACAUACGGAAAUUUAGACACU-5'    (SEQ ID NO: 1304)

AR-4171  Target:  5'-TGGTGTTGTATGCCTTTAAATCTGTGA-3'    (SEQ ID NO: 1367)

5'-UUAAAUCUGUGAUGAUCCUCAUAtg-3'      (SEQ ID NO: 1242)
                  3'-GAAAUUUAGACACUACUAGGAGUAUAC-5'    (SEQ ID NO: 1305)

AR-4184  Target:  5'-CTTTAAATCTGTGATGATCCTCATATG-3'    (SEQ ID NO: 1368)

5'-UGUGAUGAUCCUCAUAUGGCCCAgt-3'      (SEQ ID NO: 1243)
                  3'-AGACACUACUAGGAGUAUACCGGGUCA-5'    (SEQ ID NO: 1306)
```

TABLE 2-continued

Selected Anti-AR DsiRNA Agents

```
AR-4191 Target:  5'-TCTGTGATGATCCTCATATGGCCCAGT-3'    (SEQ ID NO: 1369)

5'-GUUGUGCUUGUUUACAGCACUACtc-3'     (SEQ ID NO: 1244)
                 3'-UUCAACACGAACAAAUGUCGUGAUGAG-5'   (SEQ ID NO: 1307)

AR-4221 Target:  5'-AAGTTGTGCTTGTTTACAGCACTACTC-3'   (SEQ ID NO: 1370)

5'-GUUUACUUAUCUUAUGCCACGGGaa-3'     (SEQ ID NO: 1245)
                 3'-UGCAAAUGAAUAGAAUACGGUGCCCUU-5'   (SEQ ID NO: 1308)

AR-4264 Target:  5'-ACGTTTACTTATCTTATGCCACGGGAA-3'   (SEQ ID NO: 1371)

5'-UUUAGAGAGCUAAGAUUAUCUGGgg-3'     (SEQ ID NO: 1246)
                 3'-UCAAAUCUCUCGAUUCUAAUAGACCCC-5'   (SEQ ID NO: 1309)

AR-4290 Target:  5'-AGTTTAGAGAGCTAAGATTATCTGGGG-3'   (SEQ ID NO: 1372)

5'-UAAGAUUAUCUGGGGAAAUCAAAac-3'     (SEQ ID NO: 1247)
                 3'-CGAUUCUAAUAGACCCCUUUAGUUUUG-5'   (SEQ ID NO: 1310)

AR-4300 Target:  5'-GCTAAGATTATCTGGGAAATCAAAAC-3'    (SEQ ID NO: 1373)

5'-GGGGAAAUCAAAACAAAAACAAGca-3'     (SEQ ID NO: 1248)
                 3'-GACCCCUUUAGUUUUGUUUUUGUUCGU-5'   (SEQ ID NO: 1311)

AR-4311 Target:  5'-CTGGGGAAATCAAAACAAAAACAAGCA-3'   (SEQ ID NO: 1374)
```

TABLE 3

Selected Anti-AR DsiRNA Agents, Unmodified Duplexes

```
5'-AAGUUUUUAAAAGCUGCUAAAGACU-3'  (SEQ ID NO: 460)
3'-ACUUCAAAAAUUUUCGACGAUUUCUGA-5' (SEQ ID NO: 154)
AR-252 Target: 5'-TGAAGTTTTTAAAAGCTGCTAAAGACT-3' (SEQ ID NO: 307)

5'-AGUUUUUAAAAGCUGCUAAAGACUC-3'  (SEQ ID NO: 461)
3'-CUUCAAAAAUUUUCGACGAUUUCUGAG-5' (SEQ ID NO: 155)
AR-253 Target: 5'-GAAGTTTTTAAAAGCTGCTAAAGACTC-3' (SEQ ID NO: 308)

5'-GUUUUUAAAAGCUGCUAAAGACUCG-3'  (SEQ ID NO: 462)
3'-UUCAAAAAUUUUCGACGAUUUCUGAGC-5' (SEQ ID NO: 156)
AR-254 Target: 5'-AAGTTTTTAAAAGCTGCTAAAGACTCG-3' (SEQ ID NO: 309)

5'-CGGAGCCAGAGAUCAAAAGAUGAAA-3'  (SEQ ID NO: 463)
3'-ACGCCUCGGUCUCUAGUUUUCUACUUU-5' (SEQ ID NO: 157)
AR-682 Target: 5'-TGCGGAGCCAGAGATCAAAAGATGAAA-3' (SEQ ID NO: 310)

5'-CAGAGAUCAAAAGAUGAAAAGGCAG-3'  (SEQ ID NO: 464)
3'-CGGUCUCUAGUUUUCUACUUUUCCGUC-5' (SEQ ID NO: 158)
AR-688 Target: 5'-GCCAGAGATCAAAAGATGAAAAGGCAG-3' (SEQ ID NO: 311)

5'-AGAGAUCAAAAGAUGAAAAGGCAGU-3'  (SEQ ID NO: 465)
3'-GGUCUCUAGUUUUCUACUUUUCCGUCA-5' (SEQ ID NO: 159)
AR-689 Target: 5'-CCAGAGATCAAAAGATGAAAAGGCAGT-3' (SEQ ID NO: 312)

5'-AAAGAUGAAAAGGCAGUCAGGUCUU-3'  (SEQ ID NO: 466)
3'-GUUUUCUACUUUUCCGUCAGUCCAGAA-5' (SEQ ID NO: 160)
AR-697 Target: 5'-CAAAAGATGAAAAGGCAGTCAGGTCTT-3' (SEQ ID NO: 313)

5'-AAGAUGAAAAGGCAGUCAGGUCUUC-3'  (SEQ ID NO: 467)
3'-UUUUCUACUUUUCCGUCAGUCCAGAAG-5' (SEQ ID NO: 161)
AR-698 Target: 5'-AAAAGATGAAAAGGCAGTCAGGTCTTC-3' (SEQ ID NO: 314)

5'-CAGGUCUUCAGUAGCCAAAAAACAA-3'  (SEQ ID NO: 468)
3'-CAGUCCAGAAGUCAUCGGUUUUUUGUU-5' (SEQ ID NO: 162)
AR-714 Target: 5'-GTCAGGTCTTCAGTAGCCAAAAAACAA-3' (SEQ ID NO: 315)

5'-AGGUCUUCAGUAGCCAAAAAACAAA-3'  (SEQ ID NO: 469)
3'-AGUCCAGAAGUCAUCGGUUUUUUGUUU-5' (SEQ ID NO: 163)
AR-715 Target: 5'-TCAGGTCTTCAGTAGCCAAAAAACAAA-3' (SEQ ID NO: 316)
```

TABLE 3-continued

Selected Anti-AR DsiRNA Agents, Unmodified Duplexes

```
       5'-GUAGCCAAAAAACAAAACAAACAAA-3' (SEQ ID NO: 470)
       3'-GUCAUCGGUUUUUUGUUUUGUUUGUUU-5' (SEQ ID NO: 164)
AR-724 Target: 5'-CAGTAGCCAAAAAACAAAACAAACAAA-3' (SEQ ID NO: 317)

5'-CAAAAAACAAAACAAACAAAAACAA-3' (SEQ ID NO: 471)
       3'-CGGUUUUUUGUUUUGUUUGUUUUUGUU-5' (SEQ ID NO: 165)
AR-729 Target: 5'-GCCAAAAAACAAAACAAACAAAAACAA-3' (SEQ ID NO: 318)

5'-AAAAAACAAAACAAACAAAAACAAA-3' (SEQ ID NO: 472)
       3'-GGUUUUUUGUUUUGUUUGUUUUUGUUU-5' (SEQ ID NO: 166)
AR-730 Target: 5'-CCAAAAAACAAAACAAACAAAAACAAA-3' (SEQ ID NO: 319)

5'-AAAACAAACAAAAACAAAAAAGCCG-3' (SEQ ID NO: 473)
       3'-UGUUUUGUUUGUUUUUGUUUUUUCGGC-5' (SEQ ID NO: 167)
AR-737 Target: 5'-ACAAAACAAACAAAAACAAAAAAGCCG-3' (SEQ ID NO: 320)

5'-CAAAAACAAAAAAGCCGAAAUAAAA-3' (SEQ ID NO: 474)
       3'-UUGUUUUUGUUUUUUCGGCUUUAUUUU-5' (SEQ ID NO: 168)
AR-745 Target: 5'-AACAAAAACAAAAAAGCCGAAATAAAA-3' (SEQ ID NO: 321)

5'-AAAAACAAAAAAGCCGAAAUAAAAG-3' (SEQ ID NO: 475)
       3'-UGUUUUUGUUUUUUCGGCUUUAUUUUC-5' (SEQ ID NO: 169)
AR-746 Target: 5'-ACAAAAACAAAAAAGCCGAAATAAAAG-3' (SEQ ID NO: 322)

5'-AAAACAAAAAAGCCGAAAUAAAAGA-3' (SEQ ID NO: 476)
       3'-GUUUUUGUUUUUUCGGCUUUAUUUUCU-5' (SEQ ID NO: 170)
AR-747 Target: 5'-CAAAAACAAAAAAGCCGAAATAAAAGA-3' (SEQ ID NO: 323)

5'-AAAAAGCCGAAAUAAAAGAAAAAG-3' (SEQ ID NO: 477)
       3'-UGUUUUUUCGGCUUUAUUUUCUUUUUC-5' (SEQ ID NO: 171)
AR-752 Target: 5'-ACAAAAAAGCCGAAATAAAAGAAAAAG-3' (SEQ ID NO: 324)

5'-AAAAGCCGAAAUAAAAGAAAAAGA-3' (SEQ ID NO: 478)
       3'-GUUUUUUCGGCUUUAUUUUCUUUUUCU-5' (SEQ ID NO: 172)
AR-753 Target: 5'-CAAAAAAGCCGAAATAAAAGAAAAAGA-3' (SEQ ID NO: 325)

5'-AAAGCCGAAAUAAAAGAAAAAGAUA-3' (SEQ ID NO: 479)
       3'-UUUUUCGGCUUUAUUUUCUUUUUCUAU-5' (SEQ ID NO: 173)
AR-755 Target: 5'-AAAAAGCCGAAATAAAAGAAAAAGATA-3' (SEQ ID NO: 326)

5'-CGAAAUAAAAGAAAAAGAUAAUAAC-3' (SEQ ID NO: 480)
       3'-CGGCUUUAUUUUCUUUUUCUAUUAUUG-5' (SEQ ID NO: 174)
AR-760 Target: 5'-GCCGAAATAAAAGAAAAAGATAATAAC-3' (SEQ ID NO: 327)

5'-GAAAUAAAAGAAAAAGAUAAUAACU-3' (SEQ ID NO: 481)
       3'-GGCUUUAUUUUCUUUUUCUAUUAUUGA-5' (SEQ ID NO: 175)
AR-761 Target: 5'-CCGAAATAAAAGAAAAAGATAATAACT-3' (SEQ ID NO: 328)

5'-AAAUAAAAGAAAAAGAUAAUAACUC-3' (SEQ ID NO: 482)
       3'-GCUUUAUUUUCUUUUUCUAUUAUUGAG-5' (SEQ ID NO: 176)
AR-762 Target: 5'-CGAAATAAAAGAAAAAGATAATAACTC-3' (SEQ ID NO: 329)

5'-GAAAAGAUAAUAACUCAGUUCUUA-3' (SEQ ID NO: 483)
       3'-UUCUUUUUCUAUUAUUGAGUCAAGAAU-5' (SEQ ID NO: 177)
AR-770 Target: 5'-AAGAAAAAGATAATAACTCAGTTCTTA-3' (SEQ ID NO: 330)

5'-AAGAUAAUAACUCAGUUCUUAUUUG-3' (SEQ ID NO: 484)
       3'-UUUUCUAUUAUUGAGUCAAGAAUAAAC-5' (SEQ ID NO: 178)
AR-774 Target: 5'-AAAAGATAATAACTCAGTTCTTATTTG-3' (SEQ ID NO: 331)

5'-AGAUAAUAACUCAGUUCUUAUUUGC-3' (SEQ ID NO: 485)
       3'-UUUCUAUUAUUGAGUCAAGAAUAAACG-5' (SEQ ID NO: 179)
AR-775 Target: 5'-AAAGATAATAACTCAGTTCTTATTTGC-3' (SEQ ID NO: 332)

5'-AUAAUAACUCAGUUCUUAUUUGCAC-3' (SEQ ID NO: 486)
       3'-UCUAUUAUUGAGUCAAGAAUAAACGUG-5' (SEQ ID NO: 180)
AR-777 Target: 5'-AGATAATAACTCAGTTCTTATTTGCAC-3' (SEQ ID NO: 333)

5'-UAAUAACUCAGUUCUUAUUUGCACC-3' (SEQ ID NO: 487)
       3'-CUAUUAUUGAGUCAAGAAUAAACGUGG-5' (SEQ ID NO: 181)
AR-778 Target: 5'-GATAATAACTCAGTTCTTATTTGCACC-3' (SEQ ID NO: 334)

5'-UUAUUUGCACCUACUUCAGUGGACA-3' (SEQ ID NO: 488)
       3'-AGAAUAAACGUGGAUGAAGUCACCUGU-5' (SEQ ID NO: 182)
AR-792 Target: 5'-TCTTATTTGCACCTACTTCAGTGGACA-3' (SEQ ID NO: 335)
```

TABLE 3-continued

Selected Anti-AR DsiRNA Agents, Unmodified Duplexes

```
    5'-AGUGGACACUGAAUUUGGAAGGUGG-3' (SEQ ID NO: 489)
    3'-AGUCACCUGUGACUUAAACCUUCCACC-5' (SEQ ID NO: 183)
AR-809 Target: 5'-TCAGTGGACACTGAATTTGGAAGGTGG-3' (SEQ ID NO: 336)

5'-CUGAAUUUGGAAGGUGGAGGAUUUU-3' (SEQ ID NO: 490)
    3'-GUGACUUAAACCUUCCACCUCCUAAAA-5' (SEQ ID NO: 184)
AR-817 Target: 5'-CACTGAATTTGGAAGGTGGAGGATTTT-3' (SEQ ID NO: 337)

5'-UGGAAGGUGGAGGAUUUUGUUUUUU-3' (SEQ ID NO: 491)
    3'-AAACCUUCCACCUCCUAAAACAAAAAA-5' (SEQ ID NO: 185)
AR-824 Target: 5'-TTTGGAAGGTGGAGGATTTTGTTTTTT-3' (SEQ ID NO: 338)

5'-AAGGUGGAGGAUUUUGUUUUUUUCU-3' (SEQ ID NO: 492)
    3'-CCUUCCACCUCCUAAAACAAAAAAAGA-5' (SEQ ID NO: 186)
AR-827 Target: 5'-GGAAGGTGGAGGATTTTGTTTTTTTCT-3' (SEQ ID NO: 339)

5'-GAGGAUUUUGUUUUUUUCUUUUAAG-3' (SEQ ID NO: 493)
    3'-ACCUCCUAAAACAAAAAAAGAAAAUUC-5' (SEQ ID NO: 187)
AR-833 Target: 5'-TGGAGGATTTTGTTTTTTTCTTTTAAG-3' (SEQ ID NO: 340)

5'-AGGAUUUUGUUUUUUUCUUUUAAGA-3' (SEQ ID NO: 494)
    3'-CCUCCUAAAACAAAAAAAGAAAAUUCU-5' (SEQ ID NO: 188)
AR-834 Target: 5'-GGAGGATTTTGTTTTTTTCTTTTAAGA-3' (SEQ ID NO: 341)

5'-GAUUUUGUUUUUUUCUUUUAAGAUC-3' (SEQ ID NO: 495)
    3'-UCCUAAAACAAAAAAAGAAAAUUCUAG-5' (SEQ ID NO: 189)
AR-836 Target: 5'-AGGATTTTGTTTTTTTCTTTTAAGATC-3' (SEQ ID NO: 342)

5'-AUUUUGUUUUUUUCUUUUAAGAUCU-3' (SEQ ID NO: 496)
    3'-CCUAAAACAAAAAAAGAAAAUUCUAGA-5' (SEQ ID NO: 190)
AR-837 Target: 5'-GGATTTTGTTTTTTTCTTTTAAGATCT-3' (SEQ ID NO: 343)

5'-UUUUGUUUUUUUCUUUUAAGAUCUG-3' (SEQ ID NO: 497)
    3'-CUAAAACAAAAAAAGAAAAUUCUAGAC-5' (SEQ ID NO: 191)
AR-838 Target: 5'-GATTTTGTTTTTTTCTTTTAAGATCTG-3' (SEQ ID NO: 344)

5'-UUUGUUUUUUUCUUUUAAGAUCUGG-3' (SEQ ID NO: 498)
    3'-UAAAACAAAAAAAGAAAAUUCUAGACC-5' (SEQ ID NO: 192)
AR-839 Target: 5'-ATTTTGTTTTTTTCTTTTAAGATCTGG-3' (SEQ ID NO: 345)

5'-UUUUUUUCUUUUAAGAUCUGGGCAU-3' (SEQ ID NO: 499)
    3'-ACAAAAAAAGAAAAUUCUAGACCCGUA-5' (SEQ ID NO: 193)
AR-843 Target: 5'-TGTTTTTTTCTTTTAAGATCTGGGCAT-3' (SEQ ID NO: 346)

5'-UUUUUUCUUUUAAGAUCUGGGCAUC-3' (SEQ ID NO: 500)
    3'-CAAAAAAAGAAAAUUCUAGACCCGUAG-5' (SEQ ID NO: 194)
AR-844 Target: 5'-GTTTTTTTCTTTTAAGATCTGGGCATC-3' (SEQ ID NO: 347)

5'-UAAGAUCUGGGCAUCUUUUGAAUCU-3' (SEQ ID NO: 501)
    3'-AAAUUCUAGACCCGUAGAAAACUUAGA-5' (SEQ ID NO: 195)
AR-854 Target: 5'-TTTAAGATCTGGGCATCTTTTGAATCT-3' (SEQ ID NO: 348)

5'-CUUUUGAAUCUACCCUUCAAGUAUU-3' (SEQ ID NO: 502)
    3'-UAGAAAACUUAGAUGGGAAGUUCAUAA-5' (SEQ ID NO: 196)
AR-868 Target: 5'-ATCTTTTGAATCTACCCTTCAAGTATT-3' (SEQ ID NO: 349)

5'-UUUUGAAUCUACCCUUCAAGUAUUA-3' (SEQ ID NO: 503)
    3'-AGAAAACUUAGAUGGGAAGUUCAUAAU-5' (SEQ ID NO: 197)
AR-869 Target: 5'-TCTTTTGAATCTACCCTTCAAGTATTA-3' (SEQ ID NO: 350)

5'-UUUGAAUCUACCCUUCAAGUAUUAA-3' (SEQ ID NO: 504)
    3'-GAAAACUUAGAUGGGAAGUUCAUAAUU-5' (SEQ ID NO: 198)
AR-870 Target: 5'-CTTTTGAATCTACCCTTCAAGTATTAA-3' (SEQ ID NO: 351)

5'-UUGAAUCUACCCUUCAAGUAUUAAG-3' (SEQ ID NO: 505)
    3'-AAAACUUAGAUGGGAAGUUCAUAAUUC-5' (SEQ ID NO: 199)
AR-871 Target: 5'-TTTTGAATCTACCCTTCAAGTATTAAG-3' (SEQ ID NO: 352)

5'-UGAAUCUACCCUUCAAGUAUUAAGA-3' (SEQ ID NO: 506)
    3'-AAACUUAGAUGGGAAGUUCAUAAUUCU-5' (SEQ ID NO: 200)
AR-872 Target: 5'-TTTGAATCTACCCTTCAAGTATTAAGA-3' (SEQ ID NO: 353)

5'-AAGUAUUAAGAGACAGACUGUGAGC-3' (SEQ ID NO: 507)
    3'-AGUUCAUAAUUCUCUGUCUGACACUCG-5' (SEQ ID NO: 201)
AR-886 Target: 5'-TCAAGTATTAAGAGACAGACTGTGAGC-3' (SEQ ID NO: 354)
```

TABLE 3-continued

Selected Anti-AR DsiRNA Agents, Unmodified Duplexes

```
   5'-UAUUAAGAGACAGACUGUGAGCCUA-3'  (SEQ ID NO: 508)
   3'-UCAUAAUUCUCUGUCUGACACUCGGAU-5' (SEQ ID NO: 202)
AR-889 Target: 5'-AGTATTAAGAGACAGACTGTGAGCCTA-3' (SEQ ID NO: 355)

5'-GUUGAACUCUUCUGAGCAAGAGAAG-3'  (SEQ ID NO: 509)
   3'-GACAACUUGAGAAGACUCGUUCUCUUC-5' (SEQ ID NO: 203)
AR-1067 Target: 5'-CTGTTGAACTCTTCTGAGCAAGAGAAG-3' (SEQ ID NO: 356)

5'-UUGAACUCUUCUGAGCAAGAGAAGG-3'  (SEQ ID NO: 510)
   3'-ACAACUUGAGAAGACUCGUUCUCUUCC-5' (SEQ ID NO: 204)
AR-1068 Target: 5'-TGTTGAACTCTTCTGAGCAAGAGAAGG-3' (SEQ ID NO: 357)

5'-AGGAUGGAAGUGCAGUUAGGGCUGG-3'  (SEQ ID NO: 511)
   3'-GUUCCUACCUUCACGUCAAUCCCGACC-5' (SEQ ID NO: 205)
AR-1137 Target: 5'-CAAGGATGGAAGTGCAGTTAGGGCTGG-3' (SEQ ID NO: 358)

5'-GAGGAGCUUUCCAGAAUCUGUUCCA-3'  (SEQ ID NO: 512)
   3'-GGCUCCUCGAAAGGUCUUAGACAAGGU-5' (SEQ ID NO: 206)
AR-1198 Target: 5'-CCGAGGAGCTTTCCAGAATCTGTTCCA-3' (SEQ ID NO: 359)

5'-AGGAGCUUUCCAGAAUCUGUUCCAG-3'  (SEQ ID NO: 513)
   3'-GCUCCUCGAAAGGUCUUAGACAAGGUC-5' (SEQ ID NO: 207)
AR-1199 Target: 5'-CGAGGAGCTTTCCAGAATCTGTTCCAG-3' (SEQ ID NO: 360)

5'-CUGACCUUAAAGACAUCCUGAGCGA-3'  (SEQ ID NO: 514)
   3'-GCGACUGGAAUUUCUGUAGGACUCGCU-5' (SEQ ID NO: 208)
AR-1675 Target: 5'-CGCTGACCTTAAAGACATCCTGAGCGA-3' (SEQ ID NO: 361)

5'-CAAGGACAAUUACUUAGGGGGCACU-3'  (SEQ ID NO: 515)
   3'-AGGUUCCUGUUAAUGAAUCCCCCGUGA-5' (SEQ ID NO: 209)
AR-1802 Target: 5'-TCCAAGGACAATTACTTAGGGGGCACT-3' (SEQ ID NO: 362)

5'-AAGGAGUUGUGUAAGGCAGUGUCGG-3'  (SEQ ID NO: 516)
   3'-GGUUCCUCAACACAUUCCGUCACAGCC-5' (SEQ ID NO: 210)
AR-1848 Target: 5'-CCAAGGAGTTGTGTAAGGCAGTGTCGG-3' (SEQ ID NO: 363)

5'-CUGAAGAUACUGCUGAGUAUUCCCC-3'  (SEQ ID NO: 517)
   3'-GUGACUUCUAUGACGACUCAUAAGGGG-5' (SEQ ID NO: 211)
AR-2047 Target: 5'-CACTGAAGATACTGCTGAGTATTCCCC-3' (SEQ ID NO: 364)

5'-CUGAGUAUUCCCCUUUCAAGGGAGG-3'  (SEQ ID NO: 518)
   3'-ACGACUCAUAAGGGGAAAGUUCCCUCC-5' (SEQ ID NO: 212)
AR-2059 Target: 5'-TGCTGAGTATTCCCCTTTCAAGGGAGG-3' (SEQ ID NO: 365)

5'-CUUGUGUCAAAAGCGAAAUGGGCCC-3'  (SEQ ID NO: 519)
   3'-GUGAACACAGUUUUCGCUUUACCCGGG-5' (SEQ ID NO: 213)
AR-2692 Target: 5'-CACTTGTGTCAAAAGCGAAATGGGCCC-3' (SEQ ID NO: 366)

5'-UUGUGUCAAAAGCGAAAUGGGCCCC-3'  (SEQ ID NO: 520)
   3'-UGAACACAGUUUUCGCUUUACCCGGGG-5' (SEQ ID NO: 214)
AR-2693 Target: 5'-ACTTGTGTCAAAAGCGAAATGGGCCCC-3' (SEQ ID NO: 367)

5'-CAUGUUUUGCCCAUUGACUAUUACU-3'  (SEQ ID NO: 521)
   3'-UGGUACAAAACGGGUAACUGAUAAUGA-5' (SEQ ID NO: 215)
AR-2775 Target: 5'-ACCATGTTTTGCCCATTGACTATTACT-3' (SEQ ID NO: 368)

5'-UGUUUUGCCCAUUGACUAUUACUUU-3'  (SEQ ID NO: 522)
   3'-GUACAAAACGGGUAACUGAUAAUGAAA-5' (SEQ ID NO: 216)
AR-2777 Target: 5'-CATGTTTTGCCCATTGACTATTACTTT-3' (SEQ ID NO: 369)

5'-GUGGAGAUGAAGCUUCUGGGUGUCA-3'  (SEQ ID NO: 523)
   3'-GACACCUCUACUUCGAAGACCCACAGU-5' (SEQ ID NO: 217)
AR-2827 Target: 5'-CTGTGGAGATGAAGCTTCTGGGTGTCA-3' (SEQ ID NO: 370)

5'-AAGGGAAACAGAAGUACCUGUGCGC-3'  (SEQ ID NO: 524)
   3'-ACUUCCCUUUGUCUUCAUGGACACGCG-5' (SEQ ID NO: 218)
AR-2905 Target: 5'-TGAAGGGAAACAGAAGTACCTGTGCGC-3' (SEQ ID NO: 371)

5'-AGAAAUGAUUGCACUAUUGAUAAAU-3'  (SEQ ID NO: 525)
   3'-CGUCUUUACUAACGUGAUAACUAUUUA-5' (SEQ ID NO: 219)
AR-2934 Target: 5'-GCAGAAATGATTGCACTATTGATAAAT-3' (SEQ ID NO: 372)

5'-GAAAUGAUUGCACUAUUGAUAAAUU-3'  (SEQ ID NO: 526)
   3'-GUCUUUACUAACGUGAUAACUAUUUAA-5' (SEQ ID NO: 220)
AR-2935 Target: 5'-CAGAAATGATTGCACTATTGATAAATT-3' (SEQ ID NO: 373)
```

TABLE 3-continued

Selected Anti-AR DsiRNA Agents, Unmodified Duplexes

```
    5'-AAAUGAUUGCACUAUUGAUAAAUUC-3' (SEQ ID NO: 527)
3'-UCUUUACUAACGUGAUAACUAUUUAAG-5' (SEQ ID NO: 221)
AR-2936 Target: 5'-AGAAATGATTGCACTATTGATAAATTC-3' (SEQ ID NO: 374)

5'-AUGAUUGCACUAUUGAUAAAUUCCG-3' (SEQ ID NO: 528)
3'-UUUACUAACGUGAUAACUAUUUAAGGC-5' (SEQ ID NO: 222)
AR-2938 Target: 5'-AAATGATTGCACTATTGATAAATTCCG-3' (SEQ ID NO: 375)

5'-UGAUUGCACUAUUGAUAAAUUCCGA-3' (SEQ ID NO: 529)
3'-UUACUAACGUGAUAACUAUUUAAGGCU-5' (SEQ ID NO: 223)
AR-2939 Target: 5'-AATGATTGCACTATTGATAAATTCCGA-3' (SEQ ID NO: 376)

5'-CUAUUGAUAAAUUCCGAAGGAAAAA-3' (SEQ ID NO: 530)
3'-GUGAUAACUAUUUAAGGCUUCCUUUUU-5' (SEQ ID NO: 224)
AR-2947 Target: 5'-CACTATTGATAAATTCCGAAGGAAAAA-3' (SEQ ID NO: 377)

5'-UAUUGAUAAAUUCCGAAGGAAAAAU-3' (SEQ ID NO: 531)
3'-UGAUAACUAUUUAAGGCUUCCUUUUUA-5' (SEQ ID NO: 225)
AR-2948 Target: 5'-ACTATTGATAAATTCCGAAGGAAAAAT-3' (SEQ ID NO: 378)

5'-AUUGAUAAAUUCCGAAGGAAAAAUU-3' (SEQ ID NO: 532)
3'-GAUAACUAUUUAAGGCUUCCUUUUUAA-5' (SEQ ID NO: 226)
AR-2949 Target: 5'-CTATTGATAAATTCCGAAGGAAAAATT-3' (SEQ ID NO: 379)

5'-UUGAUAAAUUCCGAAGGAAAAAUUG-3' (SEQ ID NO: 533)
3'-AUAACUAUUUAAGGCUUCCUUUUUAAC-5' (SEQ ID NO: 227)
AR-2950 Target: 5'-TATTGATAAATTCCGAAGGAAAAATTG-3' (SEQ ID NO: 380)

5'-UGAUAAAUUCCGAAGGAAAAAUUGU-3' (SEQ ID NO: 534)
3'-UAACUAUUUAAGGCUUCCUUUUUAACA-5' (SEQ ID NO: 228)
AR-2951 Target: 5'-ATTGATAAATTCCGAAGGAAAAATTGT-3' (SEQ ID NO: 381)

5'-AUAAAUUCCGAAGGAAAAAUUGUCC-3' (SEQ ID NO: 535)
3'-ACUAUUUAAGGCUUCCUUUUUAACAGG-5' (SEQ ID NO: 229)
AR-2953 Target: 5'-TGATAAATTCCGAAGGAAAAATTGTCC-3' (SEQ ID NO: 382)

5'-UAAAUUCCGAAGGAAAAAUUGUCCA-3' (SEQ ID NO: 536)
3'-CUAUUUAAGGCUUCCUUUUUAACAGGU-5' (SEQ ID NO: 230)
AR-2954 Target: 5'-GATAAATTCCGAAGGAAAAATTGTCCA-3' (SEQ ID NO: 383)

5'-AAGGAAAAAUUGUCCAUCUUGUCGU-3' (SEQ ID NO: 537)
3'-GCUUCCUUUUUAACAGGUAGAACAGCA-5' (SEQ ID NO: 231)
AR-2963 Target: 5'-CGAAGGAAAAATTGTCCATCTTGTCGT-3' (SEQ ID NO: 384)

5'-CUUGUCGUCUUCGGAAAUGUUAUGA-3' (SEQ ID NO: 538)
3'-UAGAACAGCAGAAGCCUUUACAAUACU-5' (SEQ ID NO: 232)
AR-2980 Target: 5'-ATCTTGTCGTCTTCGGAAATGTTATGA-3' (SEQ ID NO: 385)

5'-GAAAUGUUAUGAAGCAGGGAUGACU-3' (SEQ ID NO: 539)
3'-GCCUUUACAAUACUUCGUCCCUACUGA-5' (SEQ ID NO: 233)
AR-2993 Target: 5'-CGGAAATGTTATGAAGCAGGGATGACT-3' (SEQ ID NO: 386)

5'-AAUGUUAUGAAGCAGGGAUGACUCU-3' (SEQ ID NO: 540)
3'-CUUUACAAUACUUCGUCCCUACUGAGA-5' (SEQ ID NO: 234)
AR-2995 Target: 5'-GAAATGTTATGAAGCAGGGATGACTCT-3' (SEQ ID NO: 387)

5'-CGGAAGCUGAAGAAACUUGGUAAUC-3' (SEQ ID NO: 541)
3'-GGGCCUUCGACUUCUUUGAACCAUUAG-5' (SEQ ID NO: 235)
AR-3027 Target: 5'-CCCGGAAGCTGAAGAAACTTGGTAATC-3' (SEQ ID NO: 388)

5'-GAAGCUGAAGAAACUUGGUAAUCUG-3' (SEQ ID NO: 542)
3'-GCCUUCGACUUCUUUGAACCAUUAGAC-5' (SEQ ID NO: 236)
AR-3029 Target: 5'-CGGAAGCTGAAGAAACTTGGTAATCTG-3' (SEQ ID NO: 389)

5'-UGAAGAAACUUGGUAAUCUGAAACU-3' (SEQ ID NO: 543)
3'-CGACUUCUUUGAACCAUUAGACUUUGA-5' (SEQ ID NO: 237)
AR-3034 Target: 5'-GCTGAAGAAACTTGGTAATCTGAAACT-3' (SEQ ID NO: 390)

5'-GAAGAAACUUGGUAAUCUGAAACUA-3' (SEQ ID NO: 544)
3'-GACUUCUUUGAACCAUUAGACUUUGAU-5' (SEQ ID NO: 238)
AR-3035 Target: 5'-CTGAAGAAACTTGGTAATCTGAAACTA-3' (SEQ ID NO: 391)

5'-AAGAAACUUGGUAAUCUGAAACUAC-3' (SEQ ID NO: 545)
3'-ACUUCUUUGAACCAUUAGACUUUGAUG-5' (SEQ ID NO: 239)
AR-3036 Target: 5'-TGAAGAAACTTGGTAATCTGAAACTAC-3' (SEQ ID NO: 392)
```

TABLE 3-continued

Selected Anti-AR DsiRNA Agents, Unmodified Duplexes

```
      5'-GGUAAUCUGAAACUACAGGAGGAAG-3' (SEQ ID NO: 546)
      3'-AACCAUUAGACUUUGAUGUCCUCCUUC-5' (SEQ ID NO: 240)
AR-3045 Target: 5'-TTGGTAATCTGAAACTACAGGAGGAAG-3' (SEQ ID NO: 393)

5'-CUGAAACUACAGGAGGAAGGAGAGG-3' (SEQ ID NO: 547)
      3'-UAGACUUUGAUGUCCUCCUUCCUCUCC-5' (SEQ ID NO: 241)
AR-3051 Target: 5'-ATCTGAAACTACAGGAGGAAGGAGAGG-3' (SEQ ID NO: 394)

5'-CAGGAAUUCCUGUGCAUGAAAGCAC-3' (SEQ ID NO: 548)
      3'-GGGUCCUUAAGGACACGUACUUUCGUG-5' (SEQ ID NO: 242)
AR-3546 Target: 5'-CCCAGGAATTCCTGTGCATGAAAGCAC-3' (SEQ ID NO: 395)

5'-AGGAAUUCCUGUGCAUGAAAGCACU-3' (SEQ ID NO: 549)
      3'-GGUCCUUAAGGACACGUACUUUCGUGA-5' (SEQ ID NO: 243)
AR-3547 Target: 5'-CCAGGAATTCCTGTGCATGAAAGCACT-3' (SEQ ID NO: 396)

5'-GGAUGGGCUGAAAAAUCAAAAAUUC-3' (SEQ ID NO: 550)
      3'-CACCUACCCGACUUUUUAGUUUUUAAG-5' (SEQ ID NO: 244)
AR-3596 Target: 5'-GTGGATGGGCTGAAAAATCAAAAATTC-3' (SEQ ID NO: 397)

5'-GAUGGGCUGAAAAAUCAAAAAUUCU-3' (SEQ ID NO: 551)
      3'-ACCUACCCGACUUUUUAGUUUUUAAGA-5' (SEQ ID NO: 245)
AR-3597 Target: 5'-TGGATGGGCTGAAAAATCAAAAATTCT-3' (SEQ ID NO: 398)

5'-UGGGCUGAAAAAUCAAAAAUUCUUU-3' (SEQ ID NO: 552)
      3'-CUACCCGACUUUUUAGUUUUUAAGAAA-5' (SEQ ID NO: 246)
AR-3599 Target: 5'-GATGGGCTGAAAAATCAAAAATTCTTT-3' (SEQ ID NO: 399)

5'-CUGAAAAAUCAAAAAUUCUUUGAUG-3' (SEQ ID NO: 553)
      3'-CCGACUUUUUAGUUUUUAAGAAACUAC-5' (SEQ ID NO: 247)
AR-3603 Target: 5'-GGCTGAAAAATCAAAAATTCTTTGATG-3' (SEQ ID NO: 400)

5'-UGAAAAAUCAAAAAUUCUUUGAUGA-3' (SEQ ID NO: 554)
      3'-CGACUUUUUAGUUUUUAAGAAACUACU-5' (SEQ ID NO: 248)
AR-3604 Target: 5'-GCTGAAAAATCAAAAATTCTTTGATGA-3' (SEQ ID NO: 401)

5'-AAAAAUCAAAAAUUCUUUGAUGAAC-3' (SEQ ID NO: 555)
      3'-ACUUUUUAGUUUUUAAGAAACUACUUG-5' (SEQ ID NO: 249)
AR-3606 Target: 5'-TGAAAAATCAAAAATTCTTTGATGAAC-3' (SEQ ID NO: 402)

5'-AAAAUCAAAAAUUCUUUGAUGAACU-3' (SEQ ID NO: 556)
      3'-CUUUUUAGUUUUUAAGAAACUACUUGA-5' (SEQ ID NO: 250)
AR-3607 Target: 5'-GAAAAATCAAAAATTCTTTGATGAACT-3' (SEQ ID NO: 403)

5'-AAAUCAAAAAUUCUUUGAUGAACUU-3' (SEQ ID NO: 557)
      3'-UUUUUAGUUUUUAAGAAACUACUUGAA-5' (SEQ ID NO: 251)
AR-3608 Target: 5'-AAAAATCAAAAATTCTTTGATGAACTT-3' (SEQ ID NO: 404)

5'-CGAAUGAACUACAUCAAGGAACUCG-3' (SEQ ID NO: 558)
      3'-AAGCUUACUUGAUGUAGUUCCUUGAGC-5' (SEQ ID NO: 252)
AR-3633 Target: 5'-TTCGAATGAACTACATCAAGGAACTCG-3' (SEQ ID NO: 405)

5'-AAGGAACUCGAUCGUAUCAUUGCAU-3' (SEQ ID NO: 559)
      3'-AGUUCCUUGAGCUAGCAUAGUAACGUA-5' (SEQ ID NO: 253)
AR-3648 Target: 5'-TCAAGGAACTCGATCGTATCATTGCAT-3' (SEQ ID NO: 406)

5'-AGGAACUCGAUCGUAUCAUUGCAUG-3' (SEQ ID NO: 560)
      3'-GUUCCUUGAGCUAGCAUAGUAACGUAC-5' (SEQ ID NO: 254)
AR-3649 Target: 5'-CAAGGAACTCGATCGTATCATTGCATG-3' (SEQ ID NO: 407)

5'-CGUAUCAUUGCAUGCAAAAGAAAAA-3' (SEQ ID NO: 561)
      3'-UAGCAUAGUAACGUACGUUUUCUUUUU-5' (SEQ ID NO: 255)
AR-3660 Target: 5'-ATCGTATCATTGCATGCAAAAGAAAAA-3' (SEQ ID NO: 408)

5'-GUAUCAUUGCAUGCAAAAGAAAAAU-3' (SEQ ID NO: 562)
      3'-AGCAUAGUAACGUACGUUUUCUUUUU-5' (SEQ ID NO: 256)
AR-3661 Target: 5'-TCGTATCATTGCATGCAAAAGAAAAAT-3' (SEQ ID NO: 409)

5'-CAUUGCAUGCAAAAGAAAAAAUCCC-3' (SEQ ID NO: 563)
      3'-UAGUAACGUACGUUUUCUUUUUUAGGG-5' (SEQ ID NO: 257)
AR-3665 Target: 5'-ATCATTGCATGCAAAAGAAAAAATCCC-3' (SEQ ID NO: 410)

5'-CUUUUGACCUGCUAAUCAAGUCACA-3' (SEQ ID NO: 564)
      3'-GUGAAAACUGGACGAUUAGUUCAGUGU-5' (SEQ ID NO: 258)
AR-3772 Target: 5'-CACTTTTGACCTGCTAATCAAGTCACA-3' (SEQ ID NO: 411)
```

TABLE 3-continued

Selected Anti-AR DsiRNA Agents, Unmodified Duplexes

```
           5'-GUGGACUUUCCGGAAAUGAUGGCAG-3'  (SEQ ID NO: 565)
           3'-CGCACCUGAAAGGCCUUUACUACCGUC-5' (SEQ ID NO: 259)
AR-3807 Target: 5'-GCGTGGACTTTCCGGAAATGATGGCAG-3'  (SEQ ID NO: 412)

5'-UGGACUUUCCGGAAAUGAUGGCAGA-3'  (SEQ ID NO: 566)
           3'-GCACCUGAAAGGCCUUUACUACCGUCU-5' (SEQ ID NO: 260)
AR-3808 Target: 5'-CGTGGACTTTCCGGAAATGATGGCAGA-3'  (SEQ ID NO: 413)

5'-AUGGCAGAGAUCAUCUCUGUGCAAG-3'  (SEQ ID NO: 567)
           3'-ACUACCGUCUCUAGUAGAGACACGUUC-5' (SEQ ID NO: 261)
AR-3825 Target: 5'-TGATGGCAGAGATCATCTCTGTGCAAG-3'  (SEQ ID NO: 414)

5'-AGAGAUCAUCUCUGUGCAAGUGCCC-3'  (SEQ ID NO: 568)
           3'-CGUCUCUAGUAGAGACACGUUCACGGG-5' (SEQ ID NO: 262)
AR-3830 Target: 5'-GCAGAGATCATCTCTGTGCAAGTGCCC-3'  (SEQ ID NO: 415)

5'-GAGAUCAUCUCUGUGCAAGUGCCCA-3'  (SEQ ID NO: 569)
           3'-GUCUCUAGUAGAGACACGUUCACGGGU-5' (SEQ ID NO: 263)
AR-3831 Target: 5'-CAGAGATCATCTCTGTGCAAGTGCCCA-3'  (SEQ ID NO: 416)

5'-CAAGAUCCUUUCUGGGAAAGUCAAG-3'  (SEQ ID NO: 570)
           3'-GGGUUCUAGGAAAGACCCUUUCAGUUC-5' (SEQ ID NO: 264)
AR-3854 Target: 5'-CCCAAGATCCTTTCTGGGAAAGTCAAG-3'  (SEQ ID NO: 417)

5'-GAAGCAUUGGAAACCCUAUUUCCCC-3'  (SEQ ID NO: 571)
           3'-CACUUCGUAACCUUUGGGAUAAAGGGG-5' (SEQ ID NO: 265)
AR-3901 Target: 5'-GTGAAGCATTGGAAACCCTATTTCCCC-3'  (SEQ ID NO: 418)

5'-GAUGUCUUCUGCCUGUUAUAACUCU-3'  (SEQ ID NO: 572)
           3'-GUCUACAGAAGACGGACAAUAUUGAGA-5' (SEQ ID NO: 266)
AR-3949 Target: 5'-CAGATGTCTTCTGCCTGTTATAACTCT-3'  (SEQ ID NO: 419)

5'-CUUGGGGAAUUUCCUCUAUUGAUGU-3'  (SEQ ID NO: 573)
           3'-CGGAACCCCUUAAAGGAGAUAACUACA-5' (SEQ ID NO: 267)
AR-3994 Target: 5'-GCCTTGGGGAATTTCCTCTATTGATGT-3'  (SEQ ID NO: 420)

5'-UGGGGAAUUUCCUCUAUUGAUGUAC-3'  (SEQ ID NO: 574)
           3'-GAACCCCUUAAAGGAGAUAACUACAUG-5' (SEQ ID NO: 268)
AR-3996 Target: 5'-CTTGGGGAATTTCCTCTATTGATGTAC-3'  (SEQ ID NO: 421)

5'-GGGGAAUUUCCUCUAUUGAUGUACA-3'  (SEQ ID NO: 575)
           3'-AACCCCUUAAAGGAGAUAACUACAUGU-5' (SEQ ID NO: 269)
AR-3997 Target: 5'-TTGGGGAATTTCCTCTATTGATGTACA-3'  (SEQ ID NO: 422)

5'-GGGAAUUUCCUCUAUUGAUGUACAG-3'  (SEQ ID NO: 576)
           3'-ACCCCUUAAAGGAGAUAACUACAUGUC-5' (SEQ ID NO: 270)
AR-3998 Target: 5'-TGGGGAATTTCCTCTATTGATGTACAG-3'  (SEQ ID NO: 423)

5'-GGAAUUUCCUCUAUUGAUGUACAGU-3'  (SEQ ID NO: 577)
           3'-CCCCUUAAAGGAGAUAACUACAUGUCA-5' (SEQ ID NO: 271)
AR-3999 Target: 5'-GGGGAATTTCCTCTATTGATGTACAGT-3'  (SEQ ID NO: 424)

5'-AUUGAUGUACAGUCUGUCAUGAACA-3'  (SEQ ID NO: 578)
           3'-GAUAACUACAUGUCAGACAGUACUUGU-5' (SEQ ID NO: 272)
AR-4011 Target: 5'-CTATTGATGTACAGTCTGTCATGAACA-3'  (SEQ ID NO: 425)

5'-UUGAUGUACAGUCUGUCAUGAACAU-3'  (SEQ ID NO: 579)
           3'-AUAACUACAUGUCAGACAGUACUUGUA-5' (SEQ ID NO: 273)
AR-4012 Target: 5'-TATTGATGTACAGTCTGTCATGAACAT-3'  (SEQ ID NO: 426)

5'-UGAUGUACAGUCUGUCAUGAACAUG-3'  (SEQ ID NO: 580)
           3'-UAACUACAUGUCAGACAGUACUUGUAC-5' (SEQ ID NO: 274)
AR-4013 Target: 5'-ATTGATGTACAGTCTGTCATGAACATG-3'  (SEQ ID NO: 427)

5'-CAUGUUCCUGAAUUCUAUUUGCUGG-3'  (SEQ ID NO: 581)
           3'-UUGUACAAGGACUUAAGAUAAACGACC-5' (SEQ ID NO: 275)
AR-4034 Target: 5'-AACATGTTCCTGAATTCTATTTGCTGG-3'  (SEQ ID NO: 428)

5'-CUAUUUGCUGGGCUUUUUUUUCUC-3'   (SEQ ID NO: 582)
           3'-AAGAUAAACGACCCGAAAAAAAAAGAG-5' (SEQ ID NO: 276)
AR-4048 Target: 5'-TTCTATTTGCTGGGCTTTTTTTTCTC-3'   (SEQ ID NO: 429)

5'-UAUUUGCUGGGCUUUUUUUUCUCU-3'   (SEQ ID NO: 583)
           3'-AGAUAAACGACCCGAAAAAAAAAGAGA-5' (SEQ ID NO: 277)
AR-4049 Target: 5'-TCTATTTGCTGGGCTTTTTTTTCTCT-3'   (SEQ ID NO: 430)
```

TABLE 3-continued

Selected Anti-AR DsiRNA Agents, Unmodified Duplexes

```
      5'-CUGGGCUUUUUUUUCUCUUUCUCU-3' (SEQ ID NO: 584)
      3'-ACGACCCGAAAAAAAAGAGAAAGAGA-5' (SEQ ID NO: 278)
AR-4055 Target: 5'-TGCTGGGCTTTTTTTTCTCTTTCTCT-3' (SEQ ID NO: 431)

5'-UUUUUUCUCUUUCUCUCCUUUCUUU-3' (SEQ ID NO: 585)
      3'-AAAAAAAAGAGAAAGAGAGGAAAGAAA-5' (SEQ ID NO: 279)
AR-4064 Target: 5'-TTTTTTTTCTCTTTCTCTCCTTTCTTT-3' (SEQ ID NO: 432)

5'-CAGACUUUGCUUCCCAUUGUGGCUC-3' (SEQ ID NO: 586)
      3'-AAGUCUGAAACGAAGGGUAACACCGAG-5' (SEQ ID NO: 280)
AR-4128 Target: 5'-TTCAGACTTTGCTTCCCATTGTGGCTC-3' (SEQ ID NO: 433)

5'-GUGGCUCCUAUCUGUGUUUUGAAUG-3' (SEQ ID NO: 587)
      3'-AACACCGAGGAUAGACACAAAACUUAC-5' (SEQ ID NO: 281)
AR-4146 Target: 5'-TTGTGGCTCCTATCTGTGTTTTGAATG-3' (SEQ ID NO: 434)

5'-CUAUCUGUGUUUUGAAUGGUGUUGU-3' (SEQ ID NO: 588)
      3'-AGGAUAGACACAAAACUUACCACAACA-5' (SEQ ID NO: 282)
AR-4153 Target: 5'-TCCTATCTGTGTTTTGAATGGTGTTGT-3' (SEQ ID NO: 435)

5'-CUGUGUUUUGAAUGGUGUUGUAUGC-3' (SEQ ID NO: 589)
      3'-UAGACACAAAACUUACCACAACAUACG-5' (SEQ ID NO: 283)
AR-4157 Target: 5'-ATCTGTGTTTTGAATGGTGTTGTATGC-3' (SEQ ID NO: 436)

5'-UGUUUUGAAUGGUGUUGUAUGCCUU-3' (SEQ ID NO: 590)
      3'-ACACAAAACUUACCACAACAUACGGAA-5' (SEQ ID NO: 284)
AR-4160 Target: 5'-TGTGTTTTGAATGGTGTTGTATGCCTT-3' (SEQ ID NO: 437)

5'-AAUGGUGUUGUAUGCCUUUAAAUCU-3' (SEQ ID NO: 591)
      3'-ACUUACCACAACAUACGGAAAUUUAGA-5' (SEQ ID NO: 285)
AR-4167 Target: 5'-TGAATGGTGTTGTATGCCTTTAAATCT-3' (SEQ ID NO: 438)

5'-AUGGUGUUGUAUGCCUUUAAAUCUG-3' (SEQ ID NO: 592)
      3'-CUUACCACAACAUACGGAAAUUUAGAC-5' (SEQ ID NO: 286)
AR-4168 Target: 5'-GAATGGTGTTGTATGCCTTTAAATCTG-3' (SEQ ID NO: 439)

5'-UUGUAUGCCUUUAAAUCUGUGAUGA-3' (SEQ ID NO: 593)
      3'-ACAACAUACGGAAAUUUAGACACUACU-5' (SEQ ID NO: 287)
AR-4174 Target: 5'-TGTTGTATGCCTTTAAATCTGTGATGA-3' (SEQ ID NO: 440)

5'-GUAUGCCUUUAAAUCUGUGAUGAUC-3' (SEQ ID NO: 594)
      3'-AACAUACGGAAAUUUAGACACUACUAG-5' (SEQ ID NO: 288)
AR-4176 Target: 5'-TTGTATGCCTTTAAATCTGTGATGATC-3' (SEQ ID NO: 441)

5'-UAUGCCUUUAAAUCUGUGAUGAUCC-3' (SEQ ID NO: 595)
      3'-ACAUACGGAAAUUUAGACACUACUAGG-5' (SEQ ID NO: 289)
AR-4177 Target: 5'-TGTATGCCTTTAAATCTGTGATGATCC-3' (SEQ ID NO: 442)

5'-CAGUGUCAAGUUGUGCUUGUUUACA-3' (SEQ ID NO: 596)
      3'-GGGUCACAGUUCAACACGAACAAAUGU-5' (SEQ ID NO: 290)
AR-4212 Target: 5'-CCCAGTGTCAAGTTGTGCTTGTTTACA-3' (SEQ ID NO: 443)

5'-AGUGUCAAGUUGUGCUUGUUUACAG-3' (SEQ ID NO: 597)
      3'-GGUCACAGUUCAACACGAACAAAUGUC-5' (SEQ ID NO: 291)
AR-4213 Target: 5'-CCAGTGTCAAGTTGTGCTTGTTTACAG-3' (SEQ ID NO: 444)

5'-UUGUUUACAGCACUACUCUGUGCCA-3' (SEQ ID NO: 598)
      3'-CGAACAAAUGUCGUGAUGAGACACGGU-5' (SEQ ID NO: 292)
AR-4228 Target: 5'-GCTTGTTTACAGCACTACTCTGTGCCA-3' (SEQ ID NO: 445)

5'-UGUUUACAGCACUACUCUGUGCCAG-3' (SEQ ID NO: 599)
      3'-GAACAAAUGUCGUGAUGAGACACGGUC-5' (SEQ ID NO: 293)
AR-4229 Target: 5'-CTTGTTTACAGCACTACTCTGTGCCAG-3' (SEQ ID NO: 446)

5'-CAAACGUUUACUUAUCUUAUGCCAC-3' (SEQ ID NO: 600)
      3'-GUGUUUGCAAAUGAAUAGAAUACGGUG-5' (SEQ ID NO: 294)
AR-4259 Target: 5'-CACAAACGTTTACTTATCTTATGCCAC-3' (SEQ ID NO: 447)

5'-CGGGAAGUUUAGAGAGCUAAGAUUA-3' (SEQ ID NO: 601)
      3'-GUGCCCUUCAAAUCUCUCGAUUCUAAU-5' (SEQ ID NO: 295)
AR-4283 Target: 5'-CACGGGAAGTTTAGAGAGCTAAGATTA-3' (SEQ ID NO: 448)

5'-GGGAAGUUUAGAGAGCUAAGAUUAU-3' (SEQ ID NO: 602)
      3'-UGCCCUUCAAAUCUCUCGAUUCUAAUA-5' (SEQ ID NO: 296)
AR-4284 Target: 5'-ACGGGAAGTTTAGAGAGCTAAGATTAT-3' (SEQ ID NO: 449)
```

TABLE 3-continued

Selected Anti-AR DsiRNA Agents, Unmodified Duplexes

```
   5'-GGAAGUUUAGAGAGCUAAGAUUAUC-3'   (SEQ ID NO: 603)
3'-GCCCUUCAAAUCUCUCGAUUCUAAUAG-5'   (SEQ ID NO: 297)
AR-4285 Target: 5'-CGGGAAGTTTAGAGAGCTAAGATTATC-3'  (SEQ ID NO: 450)

5'-GAAGUUUAGAGAGCUAAGAUUAUCU-3'   (SEQ ID NO: 604)
3'-CCCUUCAAAUCUCUCGAUUCUAAUAGA-5'   (SEQ ID NO: 298)
AR-4286 Target: 5'-GGGAAGTTTAGAGAGCTAAGATTATCT-3'  (SEQ ID NO: 451)

5'-AGUUUAGAGAGCUAAGAUUAUCUGG-3'   (SEQ ID NO: 605)
3'-CUUCAAAUCUCUCGAUUCUAAUAGACC-5'   (SEQ ID NO: 299)
AR-4288 Target: 5'-GAAGTTTAGAGAGCTAAGATTATCTGG-3'  (SEQ ID NO: 452)

5'-AGAGAGCUAAGAUUAUCUGGGGAAA-3'   (SEQ ID NO: 606)
3'-AAUCUCUCGAUUCUAAUAGACCCCUUU-5'   (SEQ ID NO: 300)
AR-4293 Target: 5'-TTAGAGAGCTAAGATTATCTGGGGAAA-3'  (SEQ ID NO: 453)

5'-GAGAGCUAAGAUUAUCUGGGGAAAU-3'   (SEQ ID NO: 607)
3'-AUCUCUCGAUUCUAAUAGACCCCUUUA-5'   (SEQ ID NO: 301)
AR-4294 Target: 5'-TAGAGAGCTAAGATTATCTGGGGAAAT-3'  (SEQ ID NO: 454)

5'-AGAGCUAAGAUUAUCUGGGGAAAUC-3'   (SEQ ID NO: 608)
3'-UCUCUCGAUUCUAAUAGACCCCUUUAG-5'   (SEQ ID NO: 302)
AR-4295 Target: 5'-AGAGAGCTAAGATTATCTGGGGAAATC-3'  (SEQ ID NO: 455)

5'-AGAUUAUCUGGGGAAAUCAAAACAA-3'   (SEQ ID NO: 609)
3'-AUUCUAAUAGACCCCUUUAGUUUUGUU-5'   (SEQ ID NO: 303)
AR-4302 Target: 5'-TAAGATTATCTGGGGAAATCAAAACAA-3'  (SEQ ID NO: 456)

5'-GAUUAUCUGGGGAAAUCAAAACAAA-3'   (SEQ ID NO: 610)
3'-UUCUAAUAGACCCCUUUAGUUUUGUUU-5'   (SEQ ID NO: 304)
AR-4303 Target: 5'-AAGATTATCTGGGGAAATCAAAACAAA-3'  (SEQ ID NO: 457)

5'-CUGGGGAAAUCAAAACAAAACAAG-3'    (SEQ ID NO: 611)
3'-UAGACCCCUUUAGUUUUGUUUUGUUC-5'    (SEQ ID NO: 305)
AR-4309 Target: 5'-ATCTGGGGAAATCAAAACAAAACAAG-3'  (SEQ ID NO: 458)

5'-GGAAAUCAAAACAAAAACAAGCAAA-3'   (SEQ ID NO: 612)
3'-CCCCUUUAGUUUUGUUUUUGUUCGUUU-5'   (SEQ ID NO: 306)
AR-4313 Target: 5'-GGGGAAATCAAAACAAAAACAAGCAAA-3'  (SEQ ID NO: 459)

5'-GAAGUUUUUAAAAGCUGCUAAAGAC-3'   (SEQ ID NO: 856)
3'-CACUUCAAAAAUUUUCGACGAUUUCUG-5'   (SEQ ID NO: 796)
AR-251 Target: 5'-GTGAAGTTTTTAAAAGCTGCTAAAGAC-3'  (SEQ ID NO: 826)

5'-CUAGCUGCACAUUGCAAAGAAGGCU-3'   (SEQ ID NO: 857)
3'-UCGAUCGACGUGUAACGUUUCUUCCGA-5'   (SEQ ID NO: 797)
AR-524 Target: 5'-AGCTAGCTGCACATTGCAAAGAAGGCT-3'  (SEQ ID NO: 827)

5'-AUUGCAAAGAAGGCUCUUAGGAGCC-3'   (SEQ ID NO: 858)
3'-UGUAACGUUUCUUCCGAGAAUCCUCGG-5'   (SEQ ID NO: 798)
AR-534 Target: 5'-ACATTGCAAAGAAGGCTCTTAGGAGCC-3'  (SEQ ID NO: 828)

5'-CAAAACAAACAAAAACAAAAAGCC-3'    (SEQ ID NO: 859)
3'-UUGUUUUGUUUGUUUUUGUUUUUUCGG-5'   (SEQ ID NO: 799)
AR-736 Target: 5'-AACAAAACAAACAAAAACAAAAAGCC-3'  (SEQ ID NO: 829)

5'-GAUAAUAACUCAGUUCUUAUUUGCA-3'   (SEQ ID NO: 860)
3'-UUCUAUUAUUGAGUCAAGAAUAAACGU-5'   (SEQ ID NO: 800)
AR-776 Target: 5'-AAGATAATAACTCAGTTCTTATTTGCA-3'  (SEQ ID NO: 830)

5'-CAGUGGACACUGAAUUUGGAAGGUG-3'   (SEQ ID NO: 861)
3'-AAGUCACCUGUGACUUAAACCUUCCAC-5'   (SEQ ID NO: 801)
AR-808 Target: 5'-TTCAGTGGACACTGAATTTGGAAGGTG-3'  (SEQ ID NO: 831)

5'-GUGGACACUGAAUUUGGAAGGUGGA-3'   (SEQ ID NO: 862)
3'-GUCACCUGUGACUUAAACCUUCCACCU-5'   (SEQ ID NO: 802)
AR-810 Target: 5'-CAGTGGACACTGAATTTGGAAGGTGGA-3'  (SEQ ID NO: 832)

5'-UGGACACUGAAUUUGGAAGGUGGAG-3'   (SEQ ID NO: 863)
3'-UCACCUGUGACUUAAACCUUCCACCUC-5'   (SEQ ID NO: 803)
AR-811 Target: 5'-AGTGGACACTGAATTTGGAAGGTGGAG-3'  (SEQ ID NO: 833)

5'-GAAUCUACCCUUCAAGUAUUAAGAG-3'   (SEQ ID NO: 864)
3'-AACUUAGAUGGGAAGUUCAUAAUUCUC-5'   (SEQ ID NO: 804)
AR-873 Target: 5'-TTGAATCTACCCTTCAAGTATTAAGAG-3'  (SEQ ID NO: 834)
```

TABLE 3-continued

Selected Anti-AR DsiRNA Agents, Unmodified Duplexes

```
   5'-AGUAUUAAGAGACAGACUGUGAGCC-3'  (SEQ ID NO: 865)
3'-GUUCAUAAUUCUCUGUCUGACACUCGG-5'  (SEQ ID NO: 805)
AR-887 Target: 5'-CAAGTATTAAGAGACAGACTGTGAGCC-3'  (SEQ ID NO: 835)

5'-UGAGUAUUCCCCUUUCAAGGGAGGU-3'  (SEQ ID NO: 866)
3'-CGACUCAUAAGGGGAAAGUUCCCUCCA-5'  (SEQ ID NO: 806)
AR-2060 Target: 5'-GCTGAGTATTCCCCTTTCAAGGGAGGT-3'  (SEQ ID NO: 836)

5'-GAGUAUUCCCCUUUCAAGGGAGGUU-3'  (SEQ ID NO: 867)
3'-GACUCAUAAGGGGAAAGUUCCCUCCAA-5'  (SEQ ID NO: 807)
AR-2061 Target: 5'-CTGAGTATTCCCCTTTCAAGGGAGGTT-3'  (SEQ ID NO: 837)

5'-UGUGGAGAUGAAGCUUCUGGGUGUC-3'  (SEQ ID NO: 868)
3'-AGACACCUCUACUUCGAAGACCCACAG-5'  (SEQ ID NO: 808)
AR-2826 Target: 5'-TCTGTGGAGATGAAGCTTCTGGGTGTC-3'  (SEQ ID NO: 838)

5'-AGGGAAACAGAAGUACCUGUGCGCC-3'  (SEQ ID NO: 869)
3'-CUUCCCUUUGUCUUCAUGGACACGCGG-5'  (SEQ ID NO: 809)
AR-2906 Target: 5'-GAAGGGAAACAGAAGTACCTGTGCGCC-3'  (SEQ ID NO: 839)

5'-GAUAAAUUCCGAAGGAAAAAUUGUC-3'  (SEQ ID NO: 870)
3'-AACUAUUUAAGGCUUCCUUUUUAACAG-5'  (SEQ ID NO: 810)
AR-2952 Target: 5'-TTGATAAATTCCGAAGGAAAAATTGTC-3'  (SEQ ID NO: 840)

5'-AGGAAAAAUUGUCCAUCUUGUCGUC-3'  (SEQ ID NO: 871)
3'-CUUCCUUUUUAACAGGUAGAACAGCAG-5'  (SEQ ID NO: 811)
AR-2964 Target: 5'-GAAGGAAAAATTGTCCATCTTGTCGTC-3'  (SEQ ID NO: 841)

5'-GGAAAUGUUAUGAAGCAGGGAUGAC-3'  (SEQ ID NO: 872)
3'-AGCCUUUACAAUACUUCGUCCCUACUG-5'  (SEQ ID NO: 812)
AR-2992 Target: 5'-TCGGAAATGTTATGAAGCAGGGATGAC-3'  (SEQ ID NO: 842)

5'-UUGGUAAUCUGAAACUACAGGAGGA-3'  (SEQ ID NO: 873)
3'-UGAACCAUUAGACUUUGAUGUCCUCCU-5'  (SEQ ID NO: 813)
AR-3043 Target: 5'-ACTTGGTAATCTGAAACTACAGGAGGA-3'  (SEQ ID NO: 843)

5'-UGGUAAUCUGAAACUACAGGAGGAA-3'  (SEQ ID NO: 874)
3'-GAACCAUUAGACUUUGAUGUCCUCCUU-5'  (SEQ ID NO: 814)
AR-3044 Target: 5'-CTTGGTAATCTGAAACTACAGGAGGAA-3'  (SEQ ID NO: 844)

5'-UAAUCUGAAACUACAGGAGGAAGGA-3'  (SEQ ID NO: 875)
3'-CCAUUAGACUUUGAUGUCCUCCUUCCU-5'  (SEQ ID NO: 815)
AR-3047 Target: 5'-GGTAATCTGAAACTACAGGAGGAAGGA-3'  (SEQ ID NO: 845)

5'-CUGACAGUGUCACACAUUGAAGGCU-3'  (SEQ ID NO: 876)
3'-UCGACUGUCACAGUGUGUAACUUCCGA-5'  (SEQ ID NO: 816)
AR-3117 Target: 5'-AGCTGACAGTGTCACACATTGAAGGCT-3'  (SEQ ID NO: 846)

5'-CUGUCAUUCAGUACUCCUGGAUGGG-3'  (SEQ ID NO: 877)
3'-CCGACAGUAAGUCAUGAGGACCUACCC-5'  (SEQ ID NO: 817)
AR-3346 Target: 5'-GGCTGTCATTCAGTACTCCTGGATGGG-3'  (SEQ ID NO: 847)

5'-GAAAAAUCAAAAAUUCUUUGAUGAA-3'  (SEQ ID NO: 878)
3'-GACUUUUUAGUUUUUAAGAAACUACUU-5'  (SEQ ID NO: 818)
AR-3605 Target: 5'-CTGAAAAATCAAAAATTCTTTGATGAA-3'  (SEQ ID NO: 848)

5'-AAUUCUUUGAUGAACUUCGAAUGAA-3'  (SEQ ID NO: 879)
3'-UUUUAAGAAACUACUUGAAGCUUACUU-5'  (SEQ ID NO: 819)
AR-3616 Target: 5'-AAAATTCTTTGATGAACTTCGAATGAA-3'  (SEQ ID NO: 849)

5'-CUAAUCAAGUCACACAUGGUGAGCG-3'  (SEQ ID NO: 880)
3'-ACGAUUAGUUCAGUGUGUACCACUCGC-5'  (SEQ ID NO: 820)
AR-3783 Target: 5'-TGCTAATCAAGTCACACATGGTGAGCG-3'  (SEQ ID NO: 850)

5'-CGUGGACUUUCCGGAAAUGAUGGCA-3'  (SEQ ID NO: 881)
3'-UCGCACCUGAAAGGCCUUUACUACCGU-5'  (SEQ ID NO: 821)
AR-3806 Target: 5'-AGCGTGGACTTTCCGGAAATGATGGCA-3'  (SEQ ID NO: 851)

5'-UUGGGGAAUUUCCUCUAUUGAUGUA-3'  (SEQ ID NO: 882)
3'-GGAACCCCUUAAAGGAGAUAACUACAU-5'  (SEQ ID NO: 822)
AR-3995 Target: 5'-CCTTGGGGAATTTCCTCTATTGATGTA-3'  (SEQ ID NO: 852)

5'-UGUGUUUUGAAUGGUGUUGUAUGCC-3'  (SEQ ID NO: 883)
3'-AGACACAAAACUUACCACAACAUACGG-5'  (SEQ ID NO: 823)
AR-4158 Target: 5'-TCTGTGTTTTGAATGGTGTTGTATGCC-3'  (SEQ ID NO: 853)
```

TABLE 3-continued

Selected Anti-AR DsiRNA Agents, Unmodified Duplexes

```
  5'-UGUAUGCCUUUAAAUCUGUGAUGAU-3' (SEQ ID NO: 884)
3'-CAACAUACGGAAAUUUAGACACUACUA-5' (SEQ ID NO: 824)
AR-4175 Target: 5'-GTTGTATGCCTTTAAATCTGTGATGAT-3' (SEQ ID NO: 854)

5'-UAGAGAGCUAAGAUUAUCUGGGGAA-3' (SEQ ID NO: 885)
3'-AAAUCUCUCGAUUCUAAUAGACCCCUU-5' (SEQ ID NO: 825)
AR-4292 Target: 5'-TTTAGAGAGCTAAGATTATCTGGGGAA-3' (SEQ ID NO: 855)

5'-GGUGAAGUUUUUAAAAGCUGCUAAA-3' (SEQ ID NO: 1078)
3'-AGCCACUUCAAAAAUUUUCGACGAUUU-5' (SEQ ID NO: 970)
AR-248 Target: 5'-TCGGTGAAGTTTTTAAAAGCTGCTAAA-3' (SEQ ID NO: 1024)

5'-UUUUUAAAAGCUGCUAAAGACUCGG-3' (SEQ ID NO: 1079)
3'-UCAAAAAUUUUCGACGAUUUCUGAGCC-5' (SEQ ID NO: 971)
AR-255 Target: 5'-AGTTTTTAAAAGCTGCTAAAGACTCGG-3' (SEQ ID NO: 1025)

5'-AGAGAGGUAACUCCCUUUGGCUGCG-3' (SEQ ID NO: 1080)
3'-CGUCUCUCCAUUGAGGGAAACCGACGC-5' (SEQ ID NO: 972)
AR-489 Target: 5'-GCAGAGAGGTAACTCCCTTTGGCTGCG-3' (SEQ ID NO: 1026)

5'-GAGAUCAAAAGAUGAAAAGGCAGUC-3' (SEQ ID NO: 1081)
3'-GUCUCUAGUUUUCUACUUUUCCGUCAG-5' (SEQ ID NO: 973)
AR-690 Target: 5'-CAGAGATCAAAAGATGAAAAGGCAGTC-3' (SEQ ID NO: 1027)

5'-AAAAACAAAACAAACAAAAACAAAA-3' (SEQ ID NO: 1082)
3'-GUUUUUUGUUUUGUUUGUUUUUGUUUU-5' (SEQ ID NO: 974)
AR-731 Target: 5'-CAAAAAACAAAACAAACAAAAACAAAA-3' (SEQ ID NO: 1028)

5'-AUAAAAGAAAAAGAUAAUAACUCAG-3' (SEQ ID NO: 1083)
3'-UUUAUUUUCUUUUUCUAUUAUUGAGUC-5' (SEQ ID NO: 975)
AR-764 Target: 5'-AAATAAAAGAAAAAGATAATAACTCAG-3' (SEQ ID NO: 1029)

5'-AAAAAGAUAAUAACUCAGUUCUUAU-3' (SEQ ID NO: 1084)
3'-UCUUUUUCUAUUAUUGAGUCAAGAAUA-5' (SEQ ID NO: 976)
AR-771 Target: 5'-AGAAAAAGATAATAACTCAGTTCTTAT-3' (SEQ ID NO: 1030)

5'-AAUAACUCAGUUCUUAUUUGCACCU-3' (SEQ ID NO: 1085)
3'-UAUUAUUGAGUCAAGAAUAAACGUGGA-5' (SEQ ID NO: 977)
AR-779 Target: 5'-ATAATAACTCAGTTCTTATTTGCACCT-3' (SEQ ID NO: 1031)

5'-GUGGAGGAUUUUGUUUUUUUCUUUU-3' (SEQ ID NO: 1086)
3'-UCCACCUCCUAAAACAAAAAAAGAAAA-5' (SEQ ID NO: 978)
AR-830 Target: 5'-AGGTGGAGGATTTTGTTTTTTTCTTTT-3' (SEQ ID NO: 1032)

5'-UUGUUUUUUUCUUUUAAGAUCUGGG-3' (SEQ ID NO: 1087)
3'-AAAACAAAAAAAGAAAAUUCUAGACCC-5' (SEQ ID NO: 979)
AR-840 Target: 5'-TTTTGTTTTTTTCTTTTAAGATCTGGG-3' (SEQ ID NO: 1033)

5'-UUUUUCUUUUAAGAUCUGGGCAUCU-3' (SEQ ID NO: 1088)
3'-AAAAAAAGAAAAUUCUAGACCCGUAGA-5' (SEQ ID NO: 980)
AR-845 Target: 5'-TTTTTTTCTTTTAAGATCTGGGCATCT-3' (SEQ ID NO: 1034)

5'-CUGGGCAUCUUUUGAAUCUACCCUU-3' (SEQ ID NO: 1089)
3'-UAGACCCGUAGAAAACUUAGAUGGGAA-5' (SEQ ID NO: 981)
AR-860 Target: 5'-ATCTGGGCATCTTTTGAATCTACCCTT-3' (SEQ ID NO: 1035)

5'-AGGGAAGUAGGUGGAAGAUUCAGCC-3' (SEQ ID NO: 1090)
3'-AUUCCCUUCAUCCACCUUCUAAGUCGG-5' (SEQ ID NO: 982)
AR-1105 Target: 5'-TAAGGGAAGTAGGTGGAAGATTCAGCC-3' (SEQ ID NO: 1036)

5'-GGAGCUUUCCAGAAUCUGUUCCAGA-3' (SEQ ID NO: 1091)
3'-CUCCUCGAAAGGUCUUAGACAAGGUCU-5' (SEQ ID NO: 983)
AR-1200 Target: 5'-GAGGAGCTTTCCAGAATCTGTTCCAGA-3' (SEQ ID NO: 1037)

5'-CAGGAAGCAGUAUCCGAAGGCAGCA-3' (SEQ ID NO: 1092)
3'-UCGUCCUUCGUCAUAGGCUUCCGUCGU-5' (SEQ ID NO: 984)
AR-1734 Target: 5'-AGCAGGAAGCAGTATCCGAAGGCAGCA-3' (SEQ ID NO: 1038)

5'-AAGGACAAUUACUUAGGGGGCACUU-3' (SEQ ID NO: 1093)
3'-GGUUCCUGUUAAUGAAUCCCCCGUGAA-5' (SEQ ID NO: 985)
AR-1803 Target: 5'-CCAAGGACAATTACTTAGGGGGCACTT-3' (SEQ ID NO: 1039)

5'-GGAGUUGUGUAAGGCAGUGUCGGUG-3' (SEQ ID NO: 1094)
3'-UUCCUCAACACAUUCCGUCACAGCCAC-5' (SEQ ID NO: 986)
AR-1850 Target: 5'-AAGGAGTTGTGTAAGGCAGTGTCGGTG-3' (SEQ ID NO: 1040)
```

TABLE 3-continued

Selected Anti-AR DsiRNA Agents, Unmodified Duplexes

```
    5'-CAAGAGCACUGAAGAUACUGCUGAG-3' (SEQ ID NO: 1095)
3'-CCGUUCUCGUGACUUCUAUGACGACUC-5' (SEQ ID NO: 987)
AR-2039 Target: 5'-GGCAAGAGCACTGAAGATACTGCTGAG-3' (SEQ ID NO: 1041)

5'-UGAAGAUACUGCUGAGUAUUCCCCU-3' (SEQ ID NO: 1096)
3'-UGACUUCUAUGACGACUCAUAAGGGGA-5' (SEQ ID NO: 988)
AR-2048 Target: 5'-ACTGAAGATACTGCTGAGTATTCCCCT-3' (SEQ ID NO: 1042)

5'-AGGGAGGUUACACCAAAGGGCUAGA-3' (SEQ ID NO: 1097)
3'-GUUCCCUCCAAUGUGGUUUCCCGAUCU-5' (SEQ ID NO: 989)
AR-2077 Target: 5'-CAAGGGAGGTTACACCAAAGGGCTAGA-3' (SEQ ID NO: 1043)

5'-UGUGUCAAAAGCGAAAUGGGCCCCU-3' (SEQ ID NO: 1098)
3'-GAACACAGUUUUCGCUUUACCCGGGGA-5' (SEQ ID NO: 990)
AR-2694 Target: 5'-CTTGTGTCAAAAGCGAAATGGGCCCCT-3' (SEQ ID NO: 1044)

5'-GUUUUGCCCAUUGACUAUUACUUUC-3' (SEQ ID NO: 1099)
3'-UACAAAACGGGUAACUGAUAAUGAAAG-5' (SEQ ID NO: 991)
AR-2778 Target: 5'-ATGTTTTGCCCATTGACTATTACTTTC-3' (SEQ ID NO: 1045)

5'-CAAGGUCUUCUUCAAAAGAGCCGCU-3' (SEQ ID NO: 1100)
3'-ACGUUCCAGAAGAAGUUUUCUCGGCGA-5' (SEQ ID NO: 992)
AR-2879 Target: 5'-TGCAAGGTCTTCTTCAAAAGAGCCGCT-3' (SEQ ID NO: 1046)

5'-GGGAAACAGAAGUACCUGUGCGCCA-3' (SEQ ID NO: 1101)
3'-UUCCCUUUGUCUUCAUGGACACGCGGU-5' (SEQ ID NO: 993)
AR-2907 Target: 5'-AAGGGAAACAGAAGTACCTGTGCGCCA-3' (SEQ ID NO: 1047)

5'-GAUUGCACUAUUGAUAAAUUCCGAA-3' (SEQ ID NO: 1102)
3'-UACUAACGUGAUAACUAUUUAAGGCUU-5' (SEQ ID NO: 994)
AR-2940 Target: 5'-ATGATTGCACTATTGATAAATTCCGAA-3' (SEQ ID NO: 1048)

5'-AAUUCCGAAGGAAAAAUUGUCCAUC-3' (SEQ ID NO: 1103)
3'-AUUUAAGGCUUCCUUUUUAACAGGUAG-5' (SEQ ID NO: 995)
AR-2956 Target: 5'-TAAATTCCGAAGGAAAAATTGTCCATC-3' (SEQ ID NO: 1049)

5'-GGAAAAAUUGUCCAUCUUGUCGUCU-3' (SEQ ID NO: 1104)
3'-UUCCUUUUUAACAGGUAGAACAGCAGA-5' (SEQ ID NO: 996)
AR-2965 Target: 5'-AAGGAAAAATTGTCCATCTTGTCGTCT-3' (SEQ ID NO: 1050)

5'-AAAAUUGUCCAUCUUGUCGUCUUCG-3' (SEQ ID NO: 1105)
3'-CUUUUUAACAGGUAGAACAGCAGAAGC-5' (SEQ ID NO: 997)
AR-2968 Target: 5'-GAAAAATTGTCCATCTTGTCGTCTTCG-3' (SEQ ID NO: 1051)

5'-AGAAACUUGGUAAUCUGAAACUACA-3' (SEQ ID NO: 1106)
3'-CUUCUUUGAACCAUUAGACUUUGAUGU-5' (SEQ ID NO: 998)
AR-3037 Target: 5'-GAAGAAACTTGGTAATCTGAAACTACA-3' (SEQ ID NO: 1052)

5'-UUGAAGGCUAUGAAUGUCAGCCCAU-3' (SEQ ID NO: 1107)
3'-GUAACUUCCGAUACUUACAGUCGGGUA-5' (SEQ ID NO: 999)
AR-3133 Target: 5'-CATTGAAGGCTATGAATGTCAGCCCAT-3' (SEQ ID NO: 1053)

5'-GGAAUUCCUGUGCAUGAAAGCACUG-3' (SEQ ID NO: 1108)
3'-GUCCUUAAGGACACGUACUUUCGUGAC-5' (SEQ ID NO: 1000)
AR-3548 Target: 5'-CAGGAATTCCTGTGCATGAAAGCACTG-3' (SEQ ID NO: 1054)

5'-AAAAAUUCUUUGAUGAACUUCGAAU-3' (SEQ ID NO: 1109)
3'-AGUUUUUAAGAAACUACUUGAAGCUUA-5' (SEQ ID NO: 1001)
AR-3613 Target: 5'-TCAAAAATTCTTTGATGAACTTCGAAT-3' (SEQ ID NO: 1055)

5'-UUUGAUGAACUUCGAAUGAACUACA-3' (SEQ ID NO: 1110)
3'-AGAAACUACUUGAAGCUUACUUGAUGU-5' (SEQ ID NO: 1002)
AR-3621 Target: 5'-TCTTTGATGAACTTCGAATGAACTACA-3' (SEQ ID NO: 1056)

5'-GAUGAACUUCGAAUGAACUACAUCA-3' (SEQ ID NO: 1111)
3'-AACUACUUGAAGCUUACUUGAUGUAGU-5' (SEQ ID NO: 1003)
AR-3624 Target: 5'-TTGATGAACTTCGAATGAACTACATCA-3' (SEQ ID NO: 1057)

5'-GAAUGAACUACAUCAAGGAACUCGA-3' (SEQ ID NO: 1112)
3'-AGCUUACUUGAUGUAGUUCCUUGAGCU-5' (SEQ ID NO: 1004)
AR-3634 Target: 5'-TCGAATGAACTACATCAAGGAACTCGA-3' (SEQ ID NO: 1058)

5'-CAAAAGAAAAAAUCCCACAUCCUGC-3' (SEQ ID NO: 1113)
3'-ACGUUUUCUUUUUUAGGGUGUAGGACG-5' (SEQ ID NO: 1005)
AR-3674 Target: 5'-TGCAAAAGAAAAAATCCCACATCCTGC-3' (SEQ ID NO: 1059)
```

TABLE 3-continued

Selected Anti-AR DsiRNA Agents, Unmodified Duplexes

```
    5'-AGAAAAAAUCCCACAUCCUGCUCAA-3' (SEQ ID NO: 1114)
3'-UUUCUUUUUUAGGGUGUAGGACGAGUU-5'  (SEQ ID NO: 1006)
AR-3678 Target: 5'-AAAGAAAAAATCCCACATCCTGCTCAA-3' (SEQ ID NO: 1060)

5'-UUUUGACCUGCUAAUCAAGUCACAC-3' (SEQ ID NO: 1115)
3'-UGAAAACUGGACGAUUAGUUCAGUGUG-5'  (SEQ ID NO: 1007)
AR-3773 Target: 5'-ACTTTTGACCTGCTAATCAAGTCACAC-3' (SEQ ID NO: 1061)

5'-AAGAUCCUUUCUGGGAAAGUCAAGC-3' (SEQ ID NO: 1116)
3'-GGUUCUAGGAAAGACCCUUUCAGUUCG-5'  (SEQ ID NO: 1008)
AR-3855 Target: 5'-CCAAGATCCTTTCTGGGAAAGTCAAGC-3' (SEQ ID NO: 1062)

5'-AAAGUCAAGCCCAUCUAUUUCCACA-3' (SEQ ID NO: 1117)
3'-CCUUUCAGUUCGGGUAGAUAAAGGUGU-5'  (SEQ ID NO: 1009)
AR-3870 Target: 5'-GGAAAGTCAAGCCCATCTATTTCCACA-3' (SEQ ID NO: 1063)

5'-AUGUCUUCUGCCUGUUAUAACUCUG-3' (SEQ ID NO: 1118)
3'-UCUACAGAAGACGGACAAUAUUGAGAC-5'  (SEQ ID NO: 1010)
AR-3950 Target: 5'-AGATGTCTTCTGCCTGTTATAACTCTG-3' (SEQ ID NO: 1064)

5'-GAAUUUCCUCUAUUGAUGUACAGUC-3' (SEQ ID NO: 1119)
3'-CCCUUAAAGGAGAUAACUACAUGUCAG-5'  (SEQ ID NO: 1011)
AR-4000 Target: 5'-GGGAATTTCCTCTATTGATGTACAGTC-3' (SEQ ID NO: 1065)

5'-GAUGUACAGUCUGUCAUGAACAUGU-3' (SEQ ID NO: 1120)
3'-AACUACAUGUCAGACAGUACUUGUACA-5'  (SEQ ID NO: 1012)
AR-4014 Target: 5'-TTGATGTACAGTCTGTCATGAACATGT-3' (SEQ ID NO: 1066)

5'-CAGUCUGUCAUGAACAUGUUCCUGA-3' (SEQ ID NO: 1121)
3'-AUGUCAGACAGUACUUGUACAAGGACU-5'  (SEQ ID NO: 1013)
AR-4020 Target: 5'-TACAGTCTGTCATGAACATGTTCCTGA-3' (SEQ ID NO: 1067)

5'-CAUGAACAUGUUCCUGAAUUCUAUU-3' (SEQ ID NO: 1122)
3'-CAGUACUUGUACAAGGACUUAAGAUAA-5'  (SEQ ID NO: 1014)
AR-4028 Target: 5'-GTCATGAACATGTTCCTGAATTCTATT-3' (SEQ ID NO: 1068)

5'-AUGUUCCUGAAUUCUAUUUGCUGGG-3' (SEQ ID NO: 1123)
3'-UGUACAAGGACUUAAGAUAAACGACCC-5'  (SEQ ID NO: 1015)
AR-4035 Target: 5'-ACATGTTCCTGAATTCTATTTGCTGGG-3' (SEQ ID NO: 1069)

5'-UGGGCUUUUUUUUCUCUUUCUCUC-3' (SEQ ID NO: 1124)
3'-CGACCCGAAAAAAAAGAGAAAGAGAG-5'  (SEQ ID NO: 1016)
AR-4056 Target: 5'-GCTGGGCTTTTTTTTCTCTTTCTCTC-3' (SEQ ID NO: 1070)

5'-UUUUUCUCUUUCUCUCCUUUCUUUU-3' (SEQ ID NO: 1125)
3'-AAAAAAAGAGAAAGAGAGGAAAGAAAA-5'  (SEQ ID NO: 1017)
AR-4065 Target: 5'-TTTTTTTCTCTTTCTCTCCTTTCTTTT-3' (SEQ ID NO: 1071)

5'-GUUUUGAAUGGUGUUGUAUGCCUUU-3' (SEQ ID NO: 1126)
3'-CACAAAACUUACCACAACAUACGGAAA-5'  (SEQ ID NO: 1018)
AR-4161 Target: 5'-GTGTTTTGAATGGTGTTGTATGCCTTT-3' (SEQ ID NO: 1072)

5'-GGUGUUGUAUGCCUUUAAAUCUGUG-3' (SEQ ID NO: 1127)
3'-UACCACAACAUACGGAAAUUUAGACAC-5'  (SEQ ID NO: 1019)
AR-4170 Target: 5'-ATGGTGTTGTATGCCTTTAAATCTGTG-3' (SEQ ID NO: 1073)

5'-CAAGUUGUGCUUGUUUACAGCACUA-3' (SEQ ID NO: 1128)
3'-CAGUUCAACACGAACAAAUGUCGUGAU-5'  (SEQ ID NO: 1020)
AR-4218 Target: 5'-GTCAAGTTGTGCTTGTTTACAGCACTA-3' (SEQ ID NO: 1074)

5'-CUAAGAUUAUCUGGGGAAAUCAAAA-3' (SEQ ID NO: 1129)
3'-UCGAUUCUAAUAGACCCCUUUAGUUUU-5'  (SEQ ID NO: 1021)
AR-4299 Target: 5'-AGCTAAGATTATCTGGGGAAATCAAAA-3' (SEQ ID NO: 1075)

5'-UGGGGAAAUCAAAACAAAAACAAGC-3' (SEQ ID NO: 1130)
3'-AGACCCCUUUAGUUUUGUUUUUGUUCG-5'  (SEQ ID NO: 1022)
AR-4310 Target: 5'-TCTGGGGAAATCAAAACAAAAACAAGC-3' (SEQ ID NO: 1076)

5'-GAAAUCAAAACAAAAACAAGCAAAC-3' (SEQ ID NO: 1131)
3'-CCCUUUAGUUUUGUUUUUGUUCGUUUG-5'  (SEQ ID NO: 1023)
AR-4314 Target: 5'-GGGAAATCAAAACAAAAACAAGCAAAC-3' (SEQ ID NO: 1077)

5'-GUGAAGUUUUUAAAAGCUGCUAAAG-3' (SEQ ID NO: 1375)
3'-GCCACUUCAAAAAUUUUCGACGAUUUC-5'  (SEQ ID NO: 1249)
AR-249 Target: 5'-CGGTGAAGTTTTTAAAAGCTGCTAAAG-3' (SEQ ID NO: 1312)
```

TABLE 3-continued

Selected Anti-AR DsiRNA Agents, Unmodified Duplexes

```
    5'-UUUUAAAAGCUGCUAAAGACUCGGA-3' (SEQ ID NO: 1376)
3'-CAAAAAUUUUCGACGAUUUCUGAGCCU-5' (SEQ ID NO: 1250)
AR-256 Target: 5'-GTTTTTAAAAGCTGCTAAAGACTCGGA-3' (SEQ ID NO: 1313)

5'-UUAAAAGCUGCUAAAGACUCGGAGG-3' (SEQ ID NO: 1377)
3'-AAAAUUUUCGACGAUUUCUGAGCCUCC-5' (SEQ ID NO: 1251)
AR-258 Target: 5'-TTTTAAAAGCTGCTAAAGACTCGGAGG-3' (SEQ ID NO: 1314)

5'-GGAGAGAACCCUCUGUUUUCCCCCA-3' (SEQ ID NO: 1378)
3'-CGCCUCUCUUGGGAGACAAAAGGGGGU-5' (SEQ ID NO: 1252)
AR-618 Target: 5'-GCGGAGAGAACCCTCTGTTTTCCCCCA-3' (SEQ ID NO: 1315)

5'-AGAUCAAAAGAUGAAAAGGCAGUCA-3' (SEQ ID NO: 1379)
3'-UCUCUAGUUUUCUACUUUUCCGUCAGU-5' (SEQ ID NO: 1253)
AR-691 Target: 5'-AGAGATCAAAAGATGAAAAGGCAGTCA-3' (SEQ ID NO: 1316)

5'-CAAAAGAUGAAAAGGCAGUCAGGUC-3' (SEQ ID NO: 1380)
3'-UAGUUUUCUACUUUUCCGUCAGUCCAG-5' (SEQ ID NO: 1254)
AR-695 Target: 5'-ATCAAAAGATGAAAAGGCAGTCAGGTC-3' (SEQ ID NO: 1317)

5'-CAGUAGCCAAAAAACAAAACAAACA-3' (SEQ ID NO: 1381)
3'-AAGUCAUCGGUUUUUUGUUUUGUUUGU-5' (SEQ ID NO: 1255)
AR-722 Target: 5'-TTCAGTAGCCAAAAAACAAAACAAACA-3' (SEQ ID NO: 1318)

5'-AAAACAAAACAAACAAAAACAAAAA-3' (SEQ ID NO: 1382)
3'-UUUUUUGUUUUGUUUGUUUUUGUUUUU-5' (SEQ ID NO: 1256)
AR-732 Target: 5'-AAAAAACAAAACAAACAAAAACAAAAA-3' (SEQ ID NO: 1319)

5'-UAAAAGAAAAAGAUAAUAACUCAGU-3' (SEQ ID NO: 1383)
3'-UUAUUUUCUUUUUCUAUUAUUGAGUCA-5' (SEQ ID NO: 1257)
AR-765 Target: 5'-AATAAAAGAAAAAGATAATAACTCAGT-3' (SEQ ID NO: 1320)

5'-AAAGAAAAAGAUAAUAACUCAGUUC-3' (SEQ ID NO: 1384)
3'-AUUUUCUUUUUCUAUUAUUGAGUCAAG-5' (SEQ ID NO: 1258)
AR-767 Target: 5'-TAAAAGAAAAAGATAATAACTCAGTTC-3' (SEQ ID NO: 1321)

5'-AAAAGAUAAUAACUCAGUUCUUAUU-3' (SEQ ID NO: 1385)
3'-CUUUUUCUAUUAUUGAGUCAAGAAUAA-5' (SEQ ID NO: 1259)
AR-772 Target: 5'-GAAAAGATAATAACTCAGTTCTTATT-3' (SEQ ID NO: 1322)

5'-AUAACUCAGUUCUUAUUUGCACCUA-3' (SEQ ID NO: 1386)
3'-AUUAUUGAGUCAAGAAUAAACGUGGAU-5' (SEQ ID NO: 1260)
AR-780 Target: 5'-TAATAACTCAGTTCTTATTTGCACCTA-3' (SEQ ID NO: 1323)

5'-CAGUUCUUAUUUGCACCUACUUCAG-3' (SEQ ID NO: 1387)
3'-GAGUCAAGAAUAAACGUGGAUGAAGUC-5' (SEQ ID NO: 1261)
AR-786 Target: 5'-CTCAGTTCTTATTTGCACCTACTTCAG-3' (SEQ ID NO: 1324)

5'-UGGAGGAUUUUGUUUUUUUCUUUUA-3' (SEQ ID NO: 1388)
3'-CCACCUCCUAAAACAAAAAAAGAAAAU-5' (SEQ ID NO: 1262)
AR-831 Target: 5'-GGTGGAGGATTTTGTTTTTTTCTTTTA-3' (SEQ ID NO: 1325)

5'-UGUUUUUUUCUUUUAAGAUCUGGGC-3' (SEQ ID NO: 1389)
3'-AAACAAAAAAGAAAAUUCUAGACCCG-5' (SEQ ID NO: 1263)
AR-841 Target: 5'-TTTGTTTTTTTCTTTTAAGATCTGGGC-3' (SEQ ID NO: 1326)

5'-UUUUCUUUUAAGAUCUGGGCAUCUU-3' (SEQ ID NO: 1390)
3'-AAAAAAGAAAAUUCUAGACCCGUAGAA-5' (SEQ ID NO: 1264)
AR-846 Target: 5'-TTTTTTCTTTTAAGATCTGGGCATCTT-3' (SEQ ID NO: 1327)

5'-UGGGCAUCUUUUGAAUCUACCCUUC-3' (SEQ ID NO: 1391)
3'-AGACCCGUAGAAAACUUAGAUGGGAAG-5' (SEQ ID NO: 1265)
AR-861 Target: 5'-TCTGGGCATCTTTTGAATCTACCCTTC-3' (SEQ ID NO: 1328)

5'-CAAGUUUCCUUCUCUGGAGCUUCCC-3' (SEQ ID NO: 1392)
3'-GCGUUCAAAGGAAGAGACCUCGAAGGG-5' (SEQ ID NO: 1266)
AR-997 Target: 5'-CGCAAGTTTCCTTCTCTGGAGCTTCCC-3' (SEQ ID NO: 1329)

5'-GGGAAGUAGGUGGAAGAUUCAGCCA-3' (SEQ ID NO: 1393)
3'-UUCCCUUCAUCCACCUUCUAAGUCGGU-5' (SEQ ID NO: 1267)
AR-1106 Target: 5'-AAGGGAAGTAGGTGGAAGATTCAGCCA-3' (SEQ ID NO: 1330)

5'-AAGUAGGUGGAAGAUUCAGCCAAGC-3' (SEQ ID NO: 1394)
3'-CCUUCAUCCACCUUCUAAGUCGGUUCG-5' (SEQ ID NO: 1268)
AR-1109 Target: 5'-GGAAGTAGGTGGAAGATTCAGCCAAGC-3' (SEQ ID NO: 1331)
```

TABLE 3-continued

Selected Anti-AR DsiRNA Agents, Unmodified Duplexes

```
     5'-AGGACAAUUACUUAGGGGGCACUUC-3' (SEQ ID NO: 1395)
3'-GUUCCUGUUAAUGAAUCCCCCGUGAAG-5'     (SEQ ID NO: 1269)
AR-1804 Target: 5'-CAAGGACAATTACTTAGGGGGCACTTC-3' (SEQ ID NO: 1332)

5'-CGAAUGCAAAGGUUCUCUGCUAGAC-3' (SEQ ID NO: 1396)
3'-CGGCUUACGUUUCCAAGAGACGAUCUG-5'     (SEQ ID NO: 1270)
AR-2003 Target: 5'-GCCGAATGCAAAGGTTCTCTGCTAGAC-3' (SEQ ID NO: 1333)

5'-AAGAGCACUGAAGAUACUGCUGAGU-3' (SEQ ID NO: 1397)
3'-CGUUCUCGUGACUUCUAUGACGACUCA-5'     (SEQ ID NO: 1271)
AR-2040 Target: 5'-GCAAGAGCACTGAAGATACTGCTGAGT-3' (SEQ ID NO: 1334)

5'-GAAGAUACUGCUGAGUAUUCCCCUU-3' (SEQ ID NO: 1398)
3'-GACUUCUAUGACGACUCAUAAGGGGAA-5'     (SEQ ID NO: 1272)
AR-2049 Target: 5'-CTGAAGATACTGCTGAGTATTCCCCTT-3' (SEQ ID NO: 1335)

5'-GUGUCAAAAGCGAAAUGGGCCCCUG-3' (SEQ ID NO: 1399)
3'-AACACAGUUUUCGCUUUACCCGGGGAC-5'     (SEQ ID NO: 1273)
AR-2695 Target: 5'-TTGTGTCAAAAGCGAAATGGGCCCCTG-3' (SEQ ID NO: 1336)

5'-UUUUGCCCAUUGACUAUUACUUUCC-3' (SEQ ID NO: 1400)
3'-ACAAAACGGGUAACUGAUAAUGAAAGG-5'     (SEQ ID NO: 1274)
AR-2779 Target: 5'-TGTTTTGCCCATTGACTATTACTTTCC-3' (SEQ ID NO: 1337)

5'-CAUUGACUAUUACUUUCCACCCCAG-3' (SEQ ID NO: 1401)
3'-GGGUAACUGAUAAUGAAAGGUGGGGUC-5'     (SEQ ID NO: 1275)
AR-2786 Target: 5'-CCCATTGACTATTACTTTCCACCCCAG-3' (SEQ ID NO: 1338)

5'-AAGGUCUUCUUCAAAAGAGCCGCUG-3' (SEQ ID NO: 1402)
3'-CGUUCCAGAAGAAGUUUUCUCGGCGAC-5'     (SEQ ID NO: 1276)
AR-2880 Target: 5'-GCAAGGTCTTCTTCAAAAGAGCCGCTG-3' (SEQ ID NO: 1339)

5'-AUUGCACUAUUGAUAAAUUCCGAAG-3' (SEQ ID NO: 1403)
3'-ACUAACGUGAUAACUAUUUAAGGCUUC-5'     (SEQ ID NO: 1277)
AR-2941 Target: 5'-TGATTGCACTATTGATAAATTCCGAAG-3' (SEQ ID NO: 1340)

5'-CGAAGGAAAAAUUGUCCAUCUUGUC-3' (SEQ ID NO: 1404)
3'-AGGCUUCCUUUUUAACAGGUAGAACAG-5'     (SEQ ID NO: 1278)
AR-2961 Target: 5'-TCCGAAGGAAAAATTGTCCATCTTGTC-3' (SEQ ID NO: 1341)

5'-GAAAAAUUGUCCAUCUUGUCGUCUU-3' (SEQ ID NO: 1405)
3'-UCCUUUUUAACAGGUAGAACAGCAGAA-5'     (SEQ ID NO: 1279)
AR-2966 Target: 5'-AGGAAAAATTGTCCATCTTGTCGTCTT-3' (SEQ ID NO: 1342)

5'-CAGUGUCACACAUUGAAGGCUAUGA-3' (SEQ ID NO: 1406)
3'-CUGUCACAGUGUGUAACUUCCGAUACU-5'     (SEQ ID NO: 1280)
AR-3121 Target: 5'-GACAGTGTCACACATTGAAGGCTATGA-3' (SEQ ID NO: 1343)

5'-UGAAGGCUAUGAAUGUCAGCCCAUC-3' (SEQ ID NO: 1407)
3'-UAACUUCCGAUACUUACAGUCGGGUAG-5'     (SEQ ID NO: 1281)
AR-3134 Target: 5'-ATTGAAGGCTATGAATGTCAGCCCATC-3' (SEQ ID NO: 1344)

5'-AUGGCUGUCAUUCAGUACUCCUGGA-3' (SEQ ID NO: 1408)
3'-UCUACCGACAGUAAGUCAUGAGGACCU-5'     (SEQ ID NO: 1282)
AR-3342 Target: 5'-AGATGGCTGTCATTCAGTACTCCTGGA-3' (SEQ ID NO: 1345)

5'-UGGUUUUCAAUGAGUACCGCAUGCA-3' (SEQ ID NO: 1409)
3'-AGACCAAAAGUUACUCAUGGCGUACGU-5'     (SEQ ID NO: 1283)
AR-3445 Target: 5'-TCTGGTTTTCAATGAGTACCGCATGCA-3' (SEQ ID NO: 1346)

5'-GAAUUCCUGUGCAUGAAAGCACUGC-3' (SEQ ID NO: 1410)
3'-UCCUUAAGGACACGUACUUUCGUGACG-5'     (SEQ ID NO: 1284)
AR-3549 Target: 5'-AGGAATTCCTGTGCATGAAAGCACTGC-3' (SEQ ID NO: 1347)

5'-AAAAUUCUUUGAUGAACUUCGAAUG-3' (SEQ ID NO: 1411)
3'-GUUUUUAAGAAACUACUUGAAGCUUAC-5'     (SEQ ID NO: 1285)
AR-3614 Target: 5'-CAAAAATTCTTTGATGAACTTCGAATG-3' (SEQ ID NO: 1348)

5'-UUGAUGAACUUCGAAUGAACUACAU-3' (SEQ ID NO: 1412)
3'-GAAACUACUUGAAGCUUACUUGAUGUA-5'     (SEQ ID NO: 1286)
AR-3622 Target: 5'-CTTTGATGAACTTCGAATGAACTACAT-3' (SEQ ID NO: 1349)

5'-AUGAACUUCGAAUGAACUACAUCAA-3' (SEQ ID NO: 1413)
3'-ACUACUUGAAGCUUACUUGAUGUAGUU-5'     (SEQ ID NO: 1287)
AR-3625 Target: 5'-TGATGAACTTCGAATGAACTACATCAA-3' (SEQ ID NO: 1350)
```

TABLE 3-continued

Selected Anti-AR DsiRNA Agents, Unmodified Duplexes

```
      5'-AAUGAACUACAUCAAGGAACUCGAU-3' (SEQ ID NO: 1414)
      3'-GCUUACUUGAUGUAGUUCCUUGAGCUA-5' (SEQ ID NO: 1288)
AR-3635 Target: 5'-CGAATGAACTACATCAAGGAACTCGAT-3' (SEQ ID NO: 1351)

5'-UGAACUACAUCAAGGAACUCGAUCG-3' (SEQ ID NO: 1415)
      3'-UUACUUGAUGUAGUUCCUUGAGCUAGC-5' (SEQ ID NO: 1289)
AR-3637 Target: 5'-AATGAACTACATCAAGGAACTCGATCG-3' (SEQ ID NO: 1352)

5'-AAAAGAAAAAAUCCCACAUCCUGCU-3' (SEQ ID NO: 1416)
      3'-CGUUUUCUUUUUUAGGGUGUAGGACGA-5' (SEQ ID NO: 1290)
AR-3675 Target: 5'-GCAAAAGAAAAAATCCCACATCCTGCT-3' (SEQ ID NO: 1353)

5'-GAAAAAAUCCCACAUCCUGCUCAAG-3' (SEQ ID NO: 1417)
      3'-UUCUUUUUUAGGGUGUAGGACGAGUUC-5' (SEQ ID NO: 1291)
AR-3679 Target: 5'-AAGAAAAAATCCCACATCCTGCTCAAG-3' (SEQ ID NO: 1354)

5'-UUUGACCUGCUAAUCAAGUCACACA-3' (SEQ ID NO: 1418)
      3'-GAAAACUGGACGAUUAGUUCAGUGUGU-5' (SEQ ID NO: 1292)
AR-3774 Target: 5'-CTTTTGACCTGCTAATCAAGTCACACA-3' (SEQ ID NO: 1355)

5'-CUGUUAUAACUCUGCACUACUCCUC-3' (SEQ ID NO: 1419)
      3'-CGGACAAUAUUGAGACGUGAUGAGGAG-5' (SEQ ID NO: 1293)
AR-3961 Target: 5'-GCCTGTTATAACTCTGCACTACTCCTC-3' (SEQ ID NO: 1356)

5'-GUUAUAACUCUGCACUACUCCUCUG-3' (SEQ ID NO: 1420)
      3'-GACAAUAUUGAGACGUGAUGAGGAGAC-5' (SEQ ID NO: 1294)
AR-3963 Target: 5'-CTGTTATAACTCTGCACTACTCCTCTG-3' (SEQ ID NO: 1357)

5'-AAUUCCUCUAUUGAUGUACAGUCU-3' (SEQ ID NO: 1421)
      3'-CCUUAAAGGAGAUAACUACAUGUCAGA-5' (SEQ ID NO: 1295)
AR-4001 Target: 5'-GGAATTTCCTCTATTGATGTACAGTCT-3' (SEQ ID NO: 1358)

5'-CUAUUGAUGUACAGUCUGUCAUGAA-3' (SEQ ID NO: 1422)
      3'-GAGAUAACUACAUGUCAGACAGUACUU-5' (SEQ ID NO: 1296)
AR-4009 Target: 5'-CTCTATTGATGTACAGTCTGTCATGAA-3' (SEQ ID NO: 1359)

5'-AUGAACAUGUUCCUGAAUUCUAUUU-3' (SEQ ID NO: 1423)
      3'-AGUACUUGUACAAGGACUUAAGAUAAA-5' (SEQ ID NO: 1297)
AR-4029 Target: 5'-TCATGAACATGTTCCTGAATTCTATTT-3' (SEQ ID NO: 1360)

5'-CUGAAUUCUAUUUGCUGGGCUUUUU-3' (SEQ ID NO: 1424)
      3'-AGGACUUAAGAUAAACGACCCGAAAAA-5' (SEQ ID NO: 1298)
AR-4041 Target: 5'-TCCTGAATTCTATTTGCTGGGCTTTTT-3' (SEQ ID NO: 1361)

5'-UUUUUUUUCUCUUUCUCUCCUUUC-3' (SEQ ID NO: 1425)
      3'-CGAAAAAAAAGAGAAAGAGAGGAAAG-5' (SEQ ID NO: 1299)
AR-4061 Target: 5'-GCTTTTTTTTCTCTTTCTCTCCTTTC-3' (SEQ ID NO: 1362)

5'-UUUUCUCUUUCUCUCCUUUCUUUUU-3' (SEQ ID NO: 1426)
      3'-AAAAAAGAGAAAGAGAGGAAAGAAAAA-5' (SEQ ID NO: 1300)
AR-4066 Target: 5'-TTTTTTCTCTTTCTCTCCTTTCTTTTT-3' (SEQ ID NO: 1363)

5'-CUUUCUCUCCUUUCUUUUUCUUCUU-3' (SEQ ID NO: 1427)
      3'-GAGAAAGAGAGGAAAGAAAAAGAAGAA-5' (SEQ ID NO: 1301)
AR-4072 Target: 5'-CTCTTTCTCTCCTTTCTTTTTCTTCTT-3' (SEQ ID NO: 1364)

5'-AUGGCACCUUCAGACUUUGCUUCCC-3' (SEQ ID NO: 1428)
      3'-GGUACCGUGGAAGUCUGAAACGAAGGG-5' (SEQ ID NO: 1302)
AR-4118 Target: 5'-CCATGGCACCTTCAGACTTTGCTTCCC-3' (SEQ ID NO: 1365)

5'-UUUUGAAUGGUGUUGUAUGCCUUUA-3' (SEQ ID NO: 1429)
      3'-ACAAAACUUACCACAACAUACGGAAAU-5' (SEQ ID NO: 1303)
AR-4162 Target: 5'-TGTTTTGAATGGTGTTGTATGCCTTTA-3' (SEQ ID NO: 1366)

5'-GUGUUGUAUGCCUUUAAAUCUGUGA-3' (SEQ ID NO: 1430)
      3'-ACCACAACAUACGGAAAUUUAGACACU-5' (SEQ ID NO: 1304)
AR-4171 Target: 5'-TGGTGTTGTATGCCTTTAAATCTGTGA-3' (SEQ ID NO: 1367)

5'-UUAAAUCUGUGAUGAUCCUCAUAUG-3' (SEQ ID NO: 1431)
      3'-GAAAUUUAGACACUACUAGGAGUAUAC-5' (SEQ ID NO: 1305)
AR-4184 Target: 5'-CTTTAAATCTGTGATGATCCTCATATG-3' (SEQ ID NO: 1368)

5'-UGUGAUGAUCCUCAUAUGGCCCAGU-3' (SEQ ID NO: 1432)
      3'-AGACACUACUAGGAGUAUACCGGGUCA-5' (SEQ ID NO: 1306)
AR-4191 Target: 5'-TCTGTGATGATCCTCATATGGCCCAGT-3' (SEQ ID NO: 1369)
```

TABLE 3-continued

Selected Anti-AR DsiRNA Agents, Unmodified Duplexes

```
   5'-GUUGUGCUUGUUUACAGCACUACUC-3' (SEQ ID NO: 1433)
3'-UUCAACACGAACAAAUGUCGUGAUGAG-5' (SEQ ID NO: 1307)
AR-4221 Target: 5'-AAGTTGTGCTTGTTTACAGCACTACTC-3' (SEQ ID NO: 1370)

5'-GUUUACUUAUCUUAUGCCACGGGAA-3' (SEQ ID NO: 1434)
3'-UGCAAAUGAAUAGAAUACGGUGCCCUU-5' (SEQ ID NO: 1308)
AR-4264 Target: 5'-ACGTTTACTTATCTTATGCCACGGGAA-3' (SEQ ID NO: 1371)

5'-UUUAGAGAGCUAAGAUUAUCUGGGG-3' (SEQ ID NO: 1435)
3'-UCAAAUCUCUCGAUUCUAAUAGACCCC-5' (SEQ ID NO: 1309)
AR-4290 Target: 5'-AGTTTAGAGAGCTAAGATTATCTGGGG-3' (SEQ ID NO: 1372)

5'-UAAGAUUAUCUGGGGAAAUCAAAAC-3' (SEQ ID NO: 1436)
3'-CGAUUCUAAUAGACCCCUUUAGUUUUG-5' (SEQ ID NO: 1310)
AR-4300 Target: 5'-GCTAAGATTATCTGGGGAAATCAAAAC-3' (SEQ ID NO: 1373)

5'-GGGGAAAUCAAAACAAAAACAAGCA-3' (SEQ ID NO: 1437)
3'-GACCCCUUUAGUUUUGUUUUUGUUCGU-5' (SEQ ID NO: 1311)
AR-4311 Target: 5'-CTGGGGAAATCAAAACAAAAACAAGCA-3' (SEQ ID NO: 1374)
```

Projected 21 nucleotide target sequences for each DsiRNA of Tables 2-3 above and of Tables 5-12 below are presented in Table 4.

TABLE 4

DsiRNA Target Sequences (21mers)

```
AR-252 21 nt Target:   5'-TGAAGTTTTTAAAAGCTGCTA-3'   (SEQ ID NO: 613)

AR-253 21 nt Target:   5'-GAAGTTTTTAAAAGCTGCTAA-3'   (SEQ ID NO: 614)

AR-254 21 nt Target:   5'-AAGTTTTTAAAAGCTGCTAAA-3'   (SEQ ID NO: 615)

AR-682 21 nt Target:   5'-TGCGGAGCCAGAGATCAAAAG-3'   (SEQ ID NO: 616)

AR-688 21 nt Target:   5'-GCCAGAGATCAAAAGATGAAA-3'   (SEQ ID NO: 617)

AR-689 21 nt Target:   5'-CCAGAGATCAAAAGATGAAAA-3'   (SEQ ID NO: 618)

AR-697 21 nt Target:   5'-CAAAAGATGAAAAGGCAGTCA-3'   (SEQ ID NO: 619)

AR-698 21 nt Target:   5'-AAAAGATGAAAAGGCAGTCAG-3'   (SEQ ID NO: 620)

AR-714 21 nt Target:   5'-GTCAGGTCTTCAGTAGCCAAA-3'   (SEQ ID NO: 621)

AR-715 21 nt Target:   5'-TCAGGTCTTCAGTAGCCAAAA-3'   (SEQ ID NO: 622)

AR-724 21 nt Target:   5'-CAGTAGCCAAAAAACAAAACA-3'   (SEQ ID NO: 623)

AR-729 21 nt Target:   5'-GCCAAAAAACAAAACAAACAA-3'   (SEQ ID NO: 624)

AR-730 21 nt Target:   5'-CCAAAAAACAAAACAAACAAA-3'   (SEQ ID NO: 625)

AR-737 21 nt Target:   5'-ACAAAACAAACAAAAACAAAA-3'   (SEQ ID NO: 626)

AR-745 21 nt Target:   5'-AACAAAAACAAAAAGCCGAA-3'    (SEQ ID NO: 627)

AR-746 21 nt Target:   5'-ACAAAAACAAAAAGCCGAAA-3'    (SEQ ID NO: 628)

AR-747 21 nt Target:   5'-CAAAAACAAAAAGCCGAAAT-3'    (SEQ ID NO: 629)

AR-752 21 nt Target:   5'-ACAAAAAGCCGAAATAAAAG-3'    (SEQ ID NO: 630)

AR-753 21 nt Target:   5'-CAAAAAGCCGAAATAAAAGA-3'    (SEQ ID NO: 631)

AR-755 21 nt Target:   5'-AAAAGCCGAAATAAAAGAAA-3'    (SEQ ID NO: 632)

AR-760 21 nt Target:   5'-GCCGAAATAAAAGAAAAGAT-3'    (SEQ ID NO: 633)

AR-761 21 nt Target:   5'-CCGAAATAAAAGAAAAGATA-3'    (SEQ ID NO: 634)

AR-762 21 nt Target:   5'-CGAAATAAAAGAAAAGATAA-3'    (SEQ ID NO: 635)
```

TABLE 4-continued

DsiRNA Target Sequences (21mers)

| Name | | Sequence | SEQ ID NO |
|---|---|---|---|
| AR-770 | 21 nt Target: | 5'-AAGAAAAAGATAATAACTCAG-3' | (SEQ ID NO: 636) |
| AR-774 | 21 nt Target: | 5'-AAAAGATAATAACTCAGTTCT-3' | (SEQ ID NO: 637) |
| AR-775 | 21 nt Target: | 5'-AAAGATAATAACTCAGTTCTT-3' | (SEQ ID NO: 638) |
| AR-777 | 21 nt Target: | 5'-AGATAATAACTCAGTTCTTAT-3' | (SEQ ID NO: 639) |
| AR-778 | 21 nt Target: | 5'-GATAATAACTCAGTTCTTATT-3' | (SEQ ID NO: 640) |
| AR-792 | 21 nt Target: | 5'-TCTTATTTGCACCTACTTCAG-3' | (SEQ ID NO: 641) |
| AR-809 | 21 nt Target: | 5'-TCAGTGGACACTGAATTTGGA-3' | (SEQ ID NO: 642) |
| AR-817 | 21 nt Target: | 5'-CACTGAATTTGGAAGGTGGAG-3' | (SEQ ID NO: 643) |
| AR-824 | 21 nt Target: | 5'-TTTGGAAGGTGGAGGATTTTG-3' | (SEQ ID NO: 644) |
| AR-827 | 21 nt Target: | 5'-GGAAGGTGGAGGATTTTGTTT-3' | (SEQ ID NO: 645) |
| AR-833 | 21 nt Target: | 5'-TGGAGGATTTTGTTTTTTTCT-3' | (SEQ ID NO: 646) |
| AR-834 | 21 nt Target: | 5'-GGAGGATTTTGTTTTTTCTT-3' | (SEQ ID NO: 647) |
| AR-836 | 21 nt Target: | 5'-AGGATTTTGTTTTTTCTTTT-3' | (SEQ ID NO: 648) |
| AR-837 | 21 nt Target: | 5'-GGATTTTGTTTTTTCTTTTA-3' | (SEQ ID NO: 649) |
| AR-838 | 21 nt Target: | 5'-GATTTTGTTTTTTCTTTTAA-3' | (SEQ ID NO: 650) |
| AR-839 | 21 nt Target: | 5'-ATTTTGTTTTTTCTTTTAAG-3' | (SEQ ID NO: 651) |
| AR-843 | 21 nt Target: | 5'-TGTTTTTTCTTTTAAGATCT-3' | (SEQ ID NO: 652) |
| AR-844 | 21 nt Target: | 5'-GTTTTTTTCTTTTAAGATCTG-3' | (SEQ ID NO: 653) |
| AR-854 | 21 nt Target: | 5'-TTTAAGATCTGGGCATCTTTT-3' | (SEQ ID NO: 654) |
| AR-868 | 21 nt Target: | 5'-ATCTTTTGAATCTACCCTTCA-3' | (SEQ ID NO: 655) |
| AR-869 | 21 nt Target: | 5'-TCTTTTGAATCTACCCTTCAA-3' | (SEQ ID NO: 656) |
| AR-870 | 21 nt Target: | 5'-CTTTTGAATCTACCCTTCAAG-3' | (SEQ ID NO: 657) |
| AR-871 | 21 nt Target: | 5'-TTTTGAATCTACCCTTCAAGT-3' | (SEQ ID NO: 658) |
| AR-872 | 21 nt Target: | 5'-TTTGAATCTACCCTTCAAGTA-3' | (SEQ ID NO: 659) |
| AR-886 | 21 nt Target: | 5'-TCAAGTATTAAGAGACAGACT-3' | (SEQ ID NO: 660) |
| AR-889 | 21 nt Target: | 5'-AGTATTAAGAGACAGACTGTG-3' | (SEQ ID NO: 661) |
| AR-1067 | 21 nt Target: | 5'-CTGTTGAACTCTTCTGAGCAA-3' | (SEQ ID NO: 662) |
| AR-1068 | 21 nt Target: | 5'-TGTTGAACTCTTCTGAGCAAG-3' | (SEQ ID NO: 663) |
| AR-1137 | 21 nt Target: | 5'-CAAGGATGGAAGTGCAGTTAG-3' | (SEQ ID NO: 664) |
| AR-1198 | 21 nt Target: | 5'-CCGAGGAGCTTTCCAGAATCT-3' | (SEQ ID NO: 665) |
| AR-1199 | 21 nt Target: | 5'-CGAGGAGCTTTCCAGAATCTG-3' | (SEQ ID NO: 666) |
| AR-1675 | 21 nt Target: | 5'-CGCTGACCTTAAAGACATCCT-3' | (SEQ ID NO: 667) |
| AR-1802 | 21 nt Target: | 5'-TCCAAGGACAATTACTTAGGG-3' | (SEQ ID NO: 668) |
| AR-1848 | 21 nt Target: | 5'-CCAAGGAGTTGTGTAAGGCAG-3' | (SEQ ID NO: 669) |
| AR-2047 | 21 nt Target: | 5'-CACTGAAGATACTGCTGAGTA-3' | (SEQ ID NO: 670) |
| AR-2059 | 21 nt Target: | 5'-TGCTGAGTATTCCCCTTTCAA-3' | (SEQ ID NO: 671) |
| AR-2692 | 21 nt Target: | 5'-CACTTGTGTCAAAAGCGAAAT-3' | (SEQ ID NO: 672) |
| AR-2693 | 21 nt Target: | 5'-ACTTGTGTCAAAAGCGAAATG-3' | (SEQ ID NO: 673) |
| AR-2775 | 21 nt Target: | 5'-ACCATGTTTTGCCCATTGACT-3' | (SEQ ID NO: 674) |

TABLE 4-continued

DsiRNA Target Sequences (21mers)

| | | | |
|---|---|---|---|
| AR-2777 21 nt Target: | 5'-CATGTTTTGCCCATTGACTAT-3' | (SEQ ID NO: 675) |
| AR-2827 21 nt Target: | 5'-CTGTGGAGATGAAGCTTCTGG-3' | (SEQ ID NO: 676) |
| AR-2905 21 nt Target: | 5'-TGAAGGGAAACAGAAGTACCT-3' | (SEQ ID NO: 677) |
| AR-2934 21 nt Target: | 5'-GCAGAAATGATTGCACTATTG-3' | (SEQ ID NO: 678) |
| AR-2935 21 nt Target: | 5'-CAGAAATGATTGCACTATTGA-3' | (SEQ ID NO: 679) |
| AR-2936 21 nt Target: | 5'-AGAAATGATTGCACTATTGAT-3' | (SEQ ID NO: 680) |
| AR-2938 21 nt Target: | 5'-AAATGATTGCACTATTGATAA-3' | (SEQ ID NO: 681) |
| AR-2939 21 nt Target: | 5'-AATGATTGCACTATTGATAAA-3' | (SEQ ID NO: 682) |
| AR-2947 21 nt Target: | 5'-CACTATTGATAAATTCCGAAG-3' | (SEQ ID NO: 683) |
| AR-2948 21 nt Target: | 5'-ACTATTGATAAATTCCGAAGG-3' | (SEQ ID NO: 684) |
| AR-2949 21 nt Target: | 5'-CTATTGATAAATTCCGAAGGA-3' | (SEQ ID NO: 685) |
| AR-2950 21 nt Target: | 5'-TATTGATAAATTCCGAAGGAA-3' | (SEQ ID NO: 686) |
| AR-2951 21 nt Target: | 5'-ATTGATAAATTCCGAAGGAAA-3' | (SEQ ID NO: 687) |
| AR-2953 21 nt Target: | 5'-TGATAAATTCCGAAGGAAAAA-3' | (SEQ ID NO: 688) |
| AR-2954 21 nt Target: | 5'-GATAAATTCCGAAGGAAAAAT-3' | (SEQ ID NO: 689) |
| AR-2963 21 nt Target: | 5'-CGAAGGAAAAATTGTCCATCT-3' | (SEQ ID NO: 690) |
| AR-2980 21 nt Target: | 5'-ATCTTGTCGTCTTCGGAAATG-3' | (SEQ ID NO: 691) |
| AR-2993 21 nt Target: | 5'-CGGAAATGTTATGAAGCAGGG-3' | (SEQ ID NO: 692) |
| AR-2995 21 nt Target: | 5'-GAAATGTTATGAAGCAGGGAT-3' | (SEQ ID NO: 693) |
| AR-3027 21 nt Target: | 5'-CCCGGAAGCTGAAGAAACTTG-3' | (SEQ ID NO: 694) |
| AR-3029 21 nt Target: | 5'-CGGAAGCTGAAGAAACTTGGT-3' | (SEQ ID NO: 695) |
| AR-3034 21 nt Target: | 5'-GCTGAAGAAACTTGGTAATCT-3' | (SEQ ID NO: 696) |
| AR-3035 21 nt Target: | 5'-CTGAAGAAACTTGGTAATCTG-3' | (SEQ ID NO: 697) |
| AR-3036 21 nt Target: | 5'-TGAAGAAACTTGGTAATCTGA-3' | (SEQ ID NO: 698) |
| AR-3045 21 nt Target: | 5'-TTGGTAATCTGAAACTACAGG-3' | (SEQ ID NO: 699) |
| AR-3051 21 nt Target: | 5'-ATCTGAAACTACAGGAGGAAG-3' | (SEQ ID NO: 700) |
| AR-3546 21 nt Target: | 5'-CCCAGGAATTCCTGTGCATGA-3' | (SEQ ID NO: 701) |
| AR-3547 21 nt Target: | 5'-CCAGGAATTCCTGTGCATGAA-3' | (SEQ ID NO: 702) |
| AR-3596 21 nt Target: | 5'-GTGGATGGGCTGAAAAATCAA-3' | (SEQ ID NO: 703) |
| AR-3597 21 nt Target: | 5'-TGGATGGGCTGAAAAATCAAA-3' | (SEQ ID NO: 704) |
| AR-3599 21 nt Target: | 5'-GATGGGCTGAAAAATCAAAAA-3' | (SEQ ID NO: 705) |
| AR-3603 21 nt Target: | 5'-GGCTGAAAAATCAAAAATTCT-3' | (SEQ ID NO: 706) |
| AR-3604 21 nt Target: | 5'-GCTGAAAAATCAAAAATTCTT-3' | (SEQ ID NO: 707) |
| AR-3606 21 nt Target: | 5'-TGAAAAATCAAAAATTCTTTG-3' | (SEQ ID NO: 708) |
| AR-3607 21 nt Target: | 5'-GAAAAATCAAAAATTCTTTGA-3' | (SEQ ID NO: 709) |
| AR-3608 21 nt Target: | 5'-AAAAATCAAAAATTCTTTGAT-3' | (SEQ ID NO: 710) |
| AR-3633 21 nt Target: | 5'-TTCGAATGAACTACATCAAGG-3' | (SEQ ID NO: 711) |
| AR-3648 21 nt Target: | 5'-TCAAGGAACTCGATCGTATCA-3' | (SEQ ID NO: 712) |
| AR-3649 21 nt Target: | 5'-CAAGGAACTCGATCGTATCAT-3' | (SEQ ID NO: 713) |

TABLE 4-continued

DsiRNA Target Sequences (21mers)

| | | |
|---|---|---|
| AR-3660 21 nt Target: | 5'-ATCGTATCATTGCATGCAAAA-3' | (SEQ ID NO: 714) |
| AR-3661 21 nt Target: | 5'-TCGTATCATTGCATGCAAAAG-3' | (SEQ ID NO: 715) |
| AR-3665 21 nt Target: | 5'-ATCATTGCATGCAAAAGAAAA-3' | (SEQ ID NO: 716) |
| AR-3772 21 nt Target: | 5'-CACTTTTGACCTGCTAATCAA-3' | (SEQ ID NO: 717) |
| AR-3807 21 nt Target: | 5'-GCGTGGACTTTCCGGAAATGA-3' | (SEQ ID NO: 718) |
| AR-3808 21 nt Target: | 5'-CGTGGACTTTCCGGAAATGAT-3' | (SEQ ID NO: 719) |
| AR-3825 21 nt Target: | 5'-TGATGGCAGAGATCATCTCTG-3' | (SEQ ID NO: 720) |
| AR-3830 21 nt Target: | 5'-GCAGAGATCATCTCTGTGCAA-3' | (SEQ ID NO: 721) |
| AR-3831 21 nt Target: | 5'-CAGAGATCATCTCTGTGCAAG-3' | (SEQ ID NO: 722) |
| AR-3854 21 nt Target: | 5'-CCCAAGATCCTTTCTGGGAAA-3' | (SEQ ID NO: 723) |
| AR-3901 21 nt Target: | 5'-GTGAAGCATTGGAAACCCTAT-3' | (SEQ ID NO: 724) |
| AR-3949 21 nt Target: | 5'-CAGATGTCTTCTGCCTGTTAT-3' | (SEQ ID NO: 725) |
| AR-3994 21 nt Target: | 5'-GCCTTGGGGAATTTCCTCTAT-3' | (SEQ ID NO: 726) |
| AR-3996 21 nt Target: | 5'-CTTGGGGAATTTCCTCTATTG-3' | (SEQ ID NO: 727) |
| AR-3997 21 nt Target: | 5'-TTGGGGAATTTCCTCTATTGA-3' | (SEQ ID NO: 728) |
| AR-3998 21 nt Target: | 5'-TGGGGAATTTCCTCTATTGAT-3' | (SEQ ID NO: 729) |
| AR-3999 21 nt Target: | 5'-GGGGAATTTCCTCTATTGATG-3' | (SEQ ID NO: 730) |
| AR-4011 21 nt Target: | 5'-CTATTGATGTACAGTCTGTCA-3' | (SEQ ID NO: 731) |
| AR-4012 21 nt Target: | 5'-TATTGATGTACAGTCTGTCAT-3' | (SEQ ID NO: 732) |
| AR-4013 21 nt Target: | 5'-ATTGATGTACAGTCTGTCATG-3' | (SEQ ID NO: 733) |
| AR-4034 21 nt Target: | 5'-AACATGTTCCTGAATTCTATT-3' | (SEQ ID NO: 734) |
| AR-4048 21 nt Target: | 5'-TTCTATTTGCTGGGCTTTTTT-3' | (SEQ ID NO: 735) |
| AR-4049 21 nt Target: | 5'-TCTATTTGCTGGGCTTTTTTT-3' | (SEQ ID NO: 736) |
| AR-4055 21 nt Target: | 5'-TGCTGGGCTTTTTTTTCTCT-3' | (SEQ ID NO: 737) |
| AR-4064 21 nt Target: | 5'-TTTTTTTTCTCTTTCTCTCCT-3' | (SEQ ID NO: 738) |
| AR-4128 21 nt Target: | 5'-TTCAGACTTTGCTTCCCATTG-3' | (SEQ ID NO: 739) |
| AR-4146 21 nt Target: | 5'-TTGTGGCTCCTATCTGTGTTT-3' | (SEQ ID NO: 740) |
| AR-4153 21 nt Target: | 5'-TCCTATCTGTGTTTTGAATGG-3' | (SEQ ID NO: 741) |
| AR-4157 21 nt Target: | 5'-ATCTGTGTTTTGAATGGTGTT-3' | (SEQ ID NO: 742) |
| AR-4160 21 nt Target: | 5'-TGTGTTTTGAATGGTGTTGTA-3' | (SEQ ID NO: 743) |
| AR-4167 21 nt Target: | 5'-TGAATGGTGTTGTATGCCTTT-3' | (SEQ ID NO: 744) |
| AR-4168 21 nt Target: | 5'-GAATGGTGTTGTATGCCTTTA-3' | (SEQ ID NO: 745) |
| AR-4174 21 nt Target: | 5'-TGTTGTATGCCTTTAAATCTG-3' | (SEQ ID NO: 746) |
| AR-4176 21 nt Target: | 5'-TTGTATGCCTTTAAATCTGTG-3' | (SEQ ID NO: 747) |
| AR-4177 21 nt Target: | 5'-TGTATGCCTTTAAATCTGTGA-3' | (SEQ ID NO: 748) |
| AR-4212 21 nt Target: | 5'-CCCAGTGTCAAGTTGTGCTTG-3' | (SEQ ID NO: 749) |
| AR-4213 21 nt Target: | 5'-CCAGTGTCAAGTTGTGCTTGT-3' | (SEQ ID NO: 750) |
| AR-4228 21 nt Target: | 5'-GCTTGTTTACAGCACTACTCT-3' | (SEQ ID NO: 751) |
| AR-4229 21 nt Target: | 5'-CTTGTTTACAGCACTACTCTG-3' | (SEQ ID NO: 752) |

TABLE 4-continued

DsiRNA Target Sequences (21mers)

| | | |
|---|---|---|
| AR-4259 21 nt Target: | 5'-CACAAACGTTTACTTATCTTA-3' | (SEQ ID NO: 753) |
| AR-4283 21 nt Target: | 5'-CACGGGAAGTTTAGAGAGCTA-3' | (SEQ ID NO: 754) |
| AR-4284 21 nt Target: | 5'-ACGGGAAGTTTAGAGAGCTAA-3' | (SEQ ID NO: 755) |
| AR-4285 21 nt Target: | 5'-CGGGAAGTTTAGAGAGCTAAG-3' | (SEQ ID NO: 756) |
| AR-4286 21 nt Target: | 5'-GGGAAGTTTAGAGAGCTAAGA-3' | (SEQ ID NO: 757) |
| AR-4288 21 nt Target: | 5'-GAAGTTTAGAGAGCTAAGATT-3' | (SEQ ID NO: 758) |
| AR-4293 21 nt Target: | 5'-TTAGAGAGCTAAGATTATCTG-3' | (SEQ ID NO: 759) |
| AR-4294 21 nt Target: | 5'-TAGAGAGCTAAGATTATCTGG-3' | (SEQ ID NO: 760) |
| AR-4295 21 nt Target: | 5'-AGAGAGCTAAGATTATCTGGG-3' | (SEQ ID NO: 761) |
| AR-4302 21 nt Target: | 5'-TAAGATTATCTGGGGAAATCA-3' | (SEQ ID NO: 762) |
| AR-4303 21 nt Target: | 5'-AAGATTATCTGGGGAAATCAA-3' | (SEQ ID NO: 763) |
| AR-4309 21 nt Target: | 5'-ATCTGGGGAAATCAAAACAAA-3' | (SEQ ID NO: 764) |
| AR-4313 21 nt Target: | 5'-GGGGAAATCAAAACAAAACA-3' | (SEQ ID NO: 765) |
| AR-251 21 nt Target: | 5'-GTGAAGTTTTTAAAAGCTGCT-3' | (SEQ ID NO: 886) |
| AR-524 21 nt Target: | 5'-AGCTAGCTGCACATTGCAAAG-3' | (SEQ ID NO: 887) |
| AR-534 21 nt Target: | 5'-ACATTGCAAAGAAGGCTCTTA-3' | (SEQ ID NO: 888) |
| AR-736 21 nt Target: | 5'-AACAAAACAAACAAAAACAAA-3' | (SEQ ID NO: 889) |
| AR-776 21 nt Target: | 5'-AAGATAATAACTCAGTTCTTA-3' | (SEQ ID NO: 890) |
| AR-808 21 nt Target: | 5'-TTCAGTGGACACTGAATTTGG-3' | (SEQ ID NO: 891) |
| AR-810 21 nt Target: | 5'-CAGTGGACACTGAATTTGGAA-3' | (SEQ ID NO: 892) |
| AR-811 21 nt Target: | 5'-AGTGGACACTGAATTTGGAAG-3' | (SEQ ID NO: 893) |
| AR-873 21 nt Target: | 5'-TTGAATCTACCCTTCAAGTAT-3' | (SEQ ID NO: 894) |
| AR-887 21 nt Target: | 5'-CAAGTATTAAGAGACAGACTG-3' | (SEQ ID NO: 895) |
| AR-2060 21 nt Target: | 5'-GCTGAGTATTCCCCTTTCAAG-3' | (SEQ ID NO: 896) |
| AR-2061 21 nt Target: | 5'-CTGAGTATTCCCCTTTCAAGG-3' | (SEQ ID NO: 897) |
| AR-2826 21 nt Target: | 5'-TCTGTGGAGATGAAGCTTCTG-3' | (SEQ ID NO: 898) |
| AR-2906 21 nt Target: | 5'-GAAGGGAAACAGAAGTACCTG-3' | (SEQ ID NO: 899) |
| AR-2952 21 nt Target: | 5'-TTGATAAATTCCGAAGGAAAA-3' | (SEQ ID NO: 900) |
| AR-2964 21 nt Target: | 5'-GAAGGAAAAATTGTCCATCTT-3' | (SEQ ID NO: 901) |
| AR-2992 21 nt Target: | 5'-TCGGAAATGTTATGAAGCAGG-3' | (SEQ ID NO: 902) |
| AR-3043 21 nt Target: | 5'-ACTTGGTAATCTGAAACTACA-3' | (SEQ ID NO: 903) |
| AR-3044 21 nt Target: | 5'-CTTGGTAATCTGAAACTACAG-3' | (SEQ ID NO: 904) |
| AR-3047 21 nt Target: | 5'-GGTAATCTGAAACTACAGGAG-3' | (SEQ ID NO: 905) |
| AR-3117 21 nt Target: | 5'-AGCTGACAGTGTCACACATTG-3' | (SEQ ID NO: 906) |
| AR-3346 21 nt Target: | 5'-GGCTGTCATTCAGTACTCCTG-3' | (SEQ ID NO: 907) |
| AR-3605 21 nt Target: | 5'-CTGAAAAATCAAAATTCTTT-3' | (SEQ ID NO: 908) |
| AR-3616 21 nt Target: | 5'-AAAATTCTTTGATGAACTTCG-3' | (SEQ ID NO: 909) |
| AR-3783 21 nt Target: | 5'-TGCTAATCAAGTCACACATGG-3' | (SEQ ID NO: 910) |
| AR-3806 21 nt Target: | 5'-AGCGTGGACTTTCCGGAAATG-3' | (SEQ ID NO: 911) |

TABLE 4-continued

DsiRNA Target Sequences (21mers)

| | | |
|---|---|---|
| AR-3995 21 nt Target: | 5'-CCTTGGGGAATTTCCTCTATT-3' | (SEQ ID NO: 912) |
| AR-4158 21 nt Target: | 5'-TCTGTGTTTTGAATGGTGTTG-3' | (SEQ ID NO: 913) |
| AR-4175 21 nt Target: | 5'-GTTGTATGCCTTTAAATCTGT-3' | (SEQ ID NO: 914) |
| AR-4292 21 nt Target: | 5'-TTTAGAGAGCTAAGATTATCT-3' | (SEQ ID NO: 915) |
| AR-248 21 nt Target: | 5'-TCGGTGAAGTTTTTAAAAGCT-3' | (SEQ ID NO: 1132) |
| AR-255 21 nt Target: | 5'-AGTTTTTAAAAGCTGCTAAAG-3' | (SEQ ID NO: 1133) |
| AR-489 21 nt Target: | 5'-GCAGAGAGGTAACTCCCTTTG-3' | (SEQ ID NO: 1134) |
| AR-690 21 nt Target: | 5'-CAGAGATCAAAAGATGAAAAG-3' | (SEQ ID NO: 1135) |
| AR-731 21 nt Target: | 5'-CAAAAAACAAAACAAACAAAA-3' | (SEQ ID NO: 1136) |
| AR-764 21 nt Target: | 5'-AAATAAAAGAAAAAGATAATA-3' | (SEQ ID NO: 1137) |
| AR-771 21 nt Target: | 5'-AGAAAAAGATAATAACTCAGT-3' | (SEQ ID NO: 1138) |
| AR-779 21 nt Target: | 5'-ATAATAACTCAGTTCTTATTT-3' | (SEQ ID NO: 1139) |
| AR-830 21 nt Target: | 5'-AGGTGGAGGATTTTGTTTTTT-3' | (SEQ ID NO: 1140) |
| AR-840 21 nt Target: | 5'-TTTTGTTTTTTCTTTTAAGA-3' | (SEQ ID NO: 1141) |
| AR-845 21 nt Target: | 5'-TTTTTTTCTTTTAAGATCTGG-3' | (SEQ ID NO: 1142) |
| AR-860 21 nt Target: | 5'-ATCTGGGCATCTTTTGAATCT-3' | (SEQ ID NO: 1143) |
| AR-1105 21 nt Target: | 5'-TAAGGGAAGTAGGTGGAAGAT-3' | (SEQ ID NO: 1144) |
| AR-1200 21 nt Target: | 5'-GAGGAGCTTTCCAGAATCTGT-3' | (SEQ ID NO: 1145) |
| AR-1734 21 nt Target: | 5'-AGCAGGAAGCAGTATCCGAAG-3' | (SEQ ID NO: 1146) |
| AR-1803 21 nt Target: | 5'-CCAAGGACAATTACTTAGGGG-3' | (SEQ ID NO: 1147) |
| AR-1850 21 nt Target: | 5'-AAGGAGTTGTGTAAGGCAGTG-3' | (SEQ ID NO: 1148) |
| AR-2039 21 nt Target: | 5'-GGCAAGAGCACTGAAGATACT-3' | (SEQ ID NO: 1149) |
| AR-2048 21 nt Target: | 5'-ACTGAAGATACTGCTGAGTAT-3' | (SEQ ID NO: 1150) |
| AR-2077 21 nt Target: | 5'-CAAGGGAGGTTACACCAAAGG-3' | (SEQ ID NO: 1151) |
| AR-2694 21 nt Target: | 5'-CTTGTGTCAAAAGCGAAATGG-3' | (SEQ ID NO: 1152) |
| AR-2778 21 nt Target: | 5'-ATGTTTTGCCCATTGACTATT-3' | (SEQ ID NO: 1153) |
| AR-2879 21 nt Target: | 5'-TGCAAGGTCTTCTTCAAAAGA-3' | (SEQ ID NO: 1154) |
| AR-2907 21 nt Target: | 5'-AAGGGAAACAGAAGTACCTGT-3' | (SEQ ID NO: 1155) |
| AR-2940 21 nt Target: | 5'-ATGATTGCACTATTGATAAAT-3' | (SEQ ID NO: 1156) |
| AR-2956 21 nt Target: | 5'-TAAATTCCGAAGGAAAAATTG-3' | (SEQ ID NO: 1157) |
| AR-2965 21 nt Target: | 5'-AAGGAAAAATTGTCCATCTTG-3' | (SEQ ID NO: 1158) |
| AR-2968 21 nt Target: | 5'-GAAAAATTGTCCATCTTGTCG-3' | (SEQ ID NO: 1159) |
| AR-3037 21 nt Target: | 5'-GAAGAAACTTGGTAATCTGAA-3' | (SEQ ID NO: 1160) |
| AR-3133 21 nt Target: | 5'-CATTGAAGGCTATGAATGTCA-3' | (SEQ ID NO: 1161) |
| AR-3548 21 nt Target: | 5'-CAGGAATTCCTGTGCATGAAA-3' | (SEQ ID NO: 1162) |
| AR-3613 21 nt Target: | 5'-TCAAAAATTCTTTGATGAACT-3' | (SEQ ID NO: 1163) |
| AR-3621 21 nt Target: | 5'-TCTTTGATGAACTTCGAATGA-3' | (SEQ ID NO: 1164) |
| AR-3624 21 nt Target: | 5'-TTGATGAACTTCGAATGAACT-3' | (SEQ ID NO: 1165) |
| AR-3634 21 nt Target: | 5'-TCGAATGAACTACATCAAGGA-3' | (SEQ ID NO: 1166) |

TABLE 4-continued

DsiRNA Target Sequences (21mers)

| | | |
|---|---|---|
| AR-3674 21 nt Target: | 5'-TGCAAAAGAAAAAATCCCACA-3' | (SEQ ID NO: 1167) |
| AR-3678 21 nt Target: | 5'-AAAGAAAAAATCCCACATCCT-3' | (SEQ ID NO: 1168) |
| AR-3773 21 nt Target: | 5'-ACTTTTGACCTGCTAATCAAG-3' | (SEQ ID NO: 1169) |
| AR-3855 21 nt Target: | 5'-CCAAGATCCTTTCTGGGAAAG-3' | (SEQ ID NO: 1170) |
| AR-3870 21 nt Target: | 5'-GGAAAGTCAAGCCCATCTATT-3' | (SEQ ID NO: 1171) |
| AR-3950 21 nt Target: | 5'-AGATGTCTTCTGCCTGTTATA-3' | (SEQ ID NO: 1172) |
| AR-4000 21 nt Target: | 5'-GGGAATTTCCTCTATTGATGT-3' | (SEQ ID NO: 1173) |
| AR-4014 21 nt Target: | 5'-TTGATGTACAGTCTGTCATGA-3' | (SEQ ID NO: 1174) |
| AR-4020 21 nt Target: | 5'-TACAGTCTGTCATGAACATGT-3' | (SEQ ID NO: 1175) |
| AR-4028 21 nt Target: | 5'-GTCATGAACATGTTCCTGAAT-3' | (SEQ ID NO: 1176) |
| AR-4035 21 nt Target: | 5'-ACATGTTCCTGAATTCTATTT-3' | (SEQ ID NO: 1177) |
| AR-4056 21 nt Target: | 5'-GCTGGGCTTTTTTTTCTCTT-3' | (SEQ ID NO: 1178) |
| AR-4065 21 nt Target: | 5'-TTTTTTTCTCTTTCTCTCCTT-3' | (SEQ ID NO: 1179) |
| AR-4161 21 nt Target: | 5'-GTGTTTTGAATGGTGTTGTAT-3' | (SEQ ID NO: 1180) |
| AR-4170 21 nt Target: | 5'-ATGGTGTTGTATGCCTTTAAA-3' | (SEQ ID NO: 1181) |
| AR-4218 21 nt Target: | 5'-GTCAAGTTGTGCTTGTTTACA-3' | (SEQ ID NO: 1182) |
| AR-4299 21 nt Target: | 5'-AGCTAAGATTATCTGGGAAA-3' | (SEQ ID NO: 1183) |
| AR-4310 21 nt Target: | 5'-TCTGGGGAAATCAAAACAAAA-3' | (SEQ ID NO: 1184) |
| AR-4314 21 nt Target: | 5'-GGGAAATCAAAACAAAAACAA-3' | (SEQ ID NO: 1185) |
| AR-249 21 nt Target: | 5'-CGGTGAAGTTTTAAAAGCTG-3' | (SEQ ID NO: 1438) |
| AR-256 21 nt Target: | 5'-GTTTTTAAAAGCTGCTAAAGA-3' | (SEQ ID NO: 1439) |
| AR-258 21 nt Target: | 5'-TTTTAAAAGCTGCTAAAGACT-3' | (SEQ ID NO: 1440) |
| AR-618 21 nt Target: | 5'-GCGGAGAGAACCCTCTGTTTT-3' | (SEQ ID NO: 1441) |
| AR-691 21 nt Target: | 5'-AGAGATCAAAAGATGAAAAGG-3' | (SEQ ID NO: 1442) |
| AR-695 21 nt Target: | 5'-ATCAAAAGATGAAAAGGCAGT-3' | (SEQ ID NO: 1443) |
| AR-722 21 nt Target: | 5'-TTCAGTAGCCAAAAAACAAAA-3' | (SEQ ID NO: 1444) |
| AR-732 21 nt Target: | 5'-AAAAAACAAAACAAACAAAAA-3' | (SEQ ID NO: 1445) |
| AR-765 21 nt Target: | 5'-AATAAAAGAAAAAGATAATAA-3' | (SEQ ID NO: 1446) |
| AR-767 21 nt Target: | 5'-TAAAAGAAAAAGATAATAACT-3' | (SEQ ID NO: 1447) |
| AR-772 21 nt Target: | 5'-GAAAAAGATAATAACTCAGTT-3' | (SEQ ID NO: 1448) |
| AR-780 21 nt Target: | 5'-TAATAACTCAGTTCTTATTTG-3' | (SEQ ID NO: 1449) |
| AR-786 21 nt Target: | 5'-CTCAGTTCTTATTTGCACCTA-3' | (SEQ ID NO: 1450) |
| AR-831 21 nt Target: | 5'-GGTGGAGGATTTTGTTTTTTT-3' | (SEQ ID NO: 1451) |
| AR-841 21 nt Target: | 5'-TTTGTTTTTTCTTTTAAGAT-3' | (SEQ ID NO: 1452) |
| AR-846 21 nt Target: | 5'-TTTTTCTTTTAAGATCTGGG-3' | (SEQ ID NO: 1453) |
| AR-861 21 nt Target: | 5'-TCTGGGCATCTTTTGAATCTA-3' | (SEQ ID NO: 1454) |
| AR-997 21 nt Target: | 5'-CGCAAGTTTCCTTCTCTGGAG-3' | (SEQ ID NO: 1455) |
| AR-1106 21 nt Target: | 5'-AAGGGAAGTAGGTGGAAGATT-3' | (SEQ ID NO: 1456) |
| AR-1109 21 nt Target: | 5'-GGAAGTAGGTGGAAGATTCAG-3' | (SEQ ID NO: 1457) |

TABLE 4-continued

DsiRNA Target Sequences (21mers)

| | | | |
|---|---|---|---|
| AR-1804 21 nt Target: | 5'-CAAGGACAATTACTTAGGGGG-3' | (SEQ ID NO: 1458) |
| AR-2003 21 nt Target: | 5'-GCCGAATGCAAAGGTTCTCTG-3' | (SEQ ID NO: 1459) |
| AR-2040 21 nt Target: | 5'-GCAAGAGCACTGAAGATACTG-3' | (SEQ ID NO: 1460) |
| AR-2049 21 nt Target: | 5'-CTGAAGATACTGCTGAGTATT-3' | (SEQ ID NO: 1461) |
| AR-2695 21 nt Target: | 5'-TTGTGTCAAAAGCGAAATGGG-3' | (SEQ ID NO: 1462) |
| AR-2779 21 nt Target: | 5'-TGTTTTGCCCATTGACTATTA-3' | (SEQ ID NO: 1463) |
| AR-2786 21 nt Target: | 5'-CCCATTGACTATTACTTTCCA-3' | (SEQ ID NO: 1464) |
| AR-2880 21 nt Target: | 5'-GCAAGGTCTTCTTCAAAAGAG-3' | (SEQ ID NO: 1465) |
| AR-2941 21 nt Target: | 5'-TGATTGCACTATTGATAAATT-3' | (SEQ ID NO: 1466) |
| AR-2961 21 nt Target: | 5'-TCCGAAGGAAAAATTGTCCAT-3' | (SEQ ID NO: 1467) |
| AR-2966 21 nt Target: | 5'-AGGAAAAATTGTCCATCTTGT-3' | (SEQ ID NO: 1468) |
| AR-3121 21 nt Target: | 5'-GACAGTGTCACACATTGAAGG-3' | (SEQ ID NO: 1469) |
| AR-3134 21 nt Target: | 5'-ATTGAAGGCTATGAATGTCAG-3' | (SEQ ID NO: 1470) |
| AR-3342 21 nt Target: | 5'-AGATGGCTGTCATTCAGTACT-3' | (SEQ ID NO: 1471) |
| AR-3445 21 nt Target: | 5'-TCTGGTTTTCAATGAGTACCG-3' | (SEQ ID NO: 1472) |
| AR-3549 21 nt Target: | 5'-AGGAATTCCTGTGCATGAAAG-3' | (SEQ ID NO: 1473) |
| AR-3614 21 nt Target: | 5'-CAAAAATTCTTTGATGAACTT-3' | (SEQ ID NO: 1474) |
| AR-3622 21 nt Target: | 5'-CTTTGATGAACTTCGAATGAA-3' | (SEQ ID NO: 1475) |
| AR-3625 21 nt Target: | 5'-TGATGAACTTCGAATGAACTA-3' | (SEQ ID NO: 1476) |
| AR-3635 21 nt Target: | 5'-CGAATGAACTACATCAAGGAA-3' | (SEQ ID NO: 1477) |
| AR-3637 21 nt Target: | 5'-AATGAACTACATCAAGGAACT-3' | (SEQ ID NO: 1478) |
| AR-3675 21 nt Target: | 5'-GCAAAAGAAAAAATCCCACAT-3' | (SEQ ID NO: 1479) |
| AR-3679 21 nt Target: | 5'-AAGAAAAAATCCCACATCCTG-3' | (SEQ ID NO: 1480) |
| AR-3774 21 nt Target: | 5'-CTTTTGACCTGCTAATCAAGT-3' | (SEQ ID NO: 1481) |
| AR-3961 21 nt Target: | 5'-GCCTGTTATAACTCTGCACTA-3' | (SEQ ID NO: 1482) |
| AR-3963 21 nt Target: | 5'-CTGTTATAACTCTGCACTACT-3' | (SEQ ID NO: 1483) |
| AR-4001 21 nt Target: | 5'-GGAATTTCCTCTATTGATGTA-3' | (SEQ ID NO: 1484) |
| AR-4009 21 nt Target: | 5'-CTCTATTGATGTACAGTCTGT-3' | (SEQ ID NO: 1485) |
| AR-4029 21 nt Target: | 5'-TCATGAACATGTTCCTGAATT-3' | (SEQ ID NO: 1486) |
| AR-4041 21 nt Target: | 5'-TCCTGAATTCTATTTGCTGGG-3' | (SEQ ID NO: 1487) |
| AR-4061 21 nt Target: | 5'-GCTTTTTTTTCTCTTTCTCT-3' | (SEQ ID NO: 1488) |
| AR-4066 21 nt Target: | 5'-TTTTTTCTCTTTCTCTCCTTT-3' | (SEQ ID NO: 1489) |
| AR-4072 21 nt Target: | 5'-CTCTTTCTCTCCTTTCTTTTT-3' | (SEQ ID NO: 1490) |
| AR-4118 21 nt Target: | 5'-CCATGGCACCTTCAGACTTTG-3' | (SEQ ID NO: 1491) |
| AR-4162 21 nt Target: | 5'-TGTTTTGAATGGTGTTGTATG-3' | (SEQ ID NO: 1492) |
| AR-4171 21 nt Target: | 5'-TGGTGTTGTATGCCTTTAAAT-3' | (SEQ ID NO: 1493) |
| AR-4184 21 nt Target: | 5'-CTTTAAATCTGTGATGATCCT-3' | (SEQ ID NO: 1494) |
| AR-4191 21 nt Target: | 5'-TCTGTGATGATCCTCATATGG-3' | (SEQ ID NO: 1495) |
| AR-4221 21 nt Target: | 5'-AAGTTGTGCTTGTTTACAGCA-3' | (SEQ ID NO: 1496) |

TABLE 4-continued

DsiRNA Target Sequences (21mers)

| Name | Sequence | SEQ ID NO |
|---|---|---|
| AR-4264 21 nt Target: | 5'-ACGTTTACTTATCTTATGCCA-3' | (SEQ ID NO: 1497) |
| AR-4290 21 nt Target: | 5'-AGTTTAGAGAGCTAAGATTAT-3' | (SEQ ID NO: 1498) |
| AR-4300 21 nt Target: | 5'-GCTAAGATTATCTGGGGAAAT-3' | (SEQ ID NO: 1499) |
| AR-4311 21 nt Target: | 5'-CTGGGGAAATCAAAACAAAAA-3' | (SEQ ID NO: 1500) |
| AR-39 21 nt Target: | 5'-GAGCCAGCTTGCTGGGAGAGC-3' | (SEQ ID NO: 3121) |
| AR-174 21 nt Target: | 5'-CGGCTCCAGCGACAGCCAACG-3' | (SEQ ID NO: 3122) |
| AR-186 21 nt Target: | 5'-CAGCCAACGCCTCTTGCAGCG-3' | (SEQ ID NO: 3123) |
| AR-194 21 nt Target: | 5'-GCCTCTTGCAGCGCGGCGGCT-3' | (SEQ ID NO: 3124) |
| AR-200 21 nt Target: | 5'-TGCAGCGCGGCGGCTTCGAAG-3' | (SEQ ID NO: 3125) |
| AR-216 21 nt Target: | 5'-CGAAGCCGCCGCCCGGAGCTG-3' | (SEQ ID NO: 3126) |
| AR-222 21 nt Target: | 5'-CGCCGCCCGGAGCTGCCCTTT-3' | (SEQ ID NO: 3127) |
| AR-252 21 nt Target: | 5'-TGAAGTTTTTAAAAGCTGCTA-3' | (SEQ ID NO: 3128) |
| AR-375 21 nt Target: | 5'-CCGTCTTCTCTCCCGCAGCTG-3' | (SEQ ID NO: 3129) |
| AR-387 21 nt Target: | 5'-CCGCAGCTGCCTCAGTCGGCT-3' | (SEQ ID NO: 3130) |
| AR-506 21 nt Target: | 5'-TTTGGCTGCGAGCGGGCGAGC-3' | (SEQ ID NO: 3131) |
| AR-518 21 nt Target: | 5'-CGGGCGAGCTAGCTGCACATT-3' | (SEQ ID NO: 3132) |
| AR-646 21 nt Target: | 5'-TCTCTCTCCACCTCCTCCTGC-3' | (SEQ ID NO: 3133) |
| AR-689 21 nt Target: | 5'-CCAGAGATCAAAAGATGAAAA-3' | (SEQ ID NO: 3134) |
| AR-724 21 nt Target: | 5'-CAGTAGCCAAAAAACAAAACA-3' | (SEQ ID NO: 3135) |
| AR-730 21 nt Target: | 5'-CCAAAAAACAAAACAAACAAA-3' | (SEQ ID NO: 3136) |
| AR-737 21 nt Target: | 5'-ACAAAACAAACAAAAACAAAA-3' | (SEQ ID NO: 3137) |
| AR-752 21 nt Target: | 5'-ACAAAAAAGCCGAAATAAAAG-3' | (SEQ ID NO: 3138) |
| AR-760 21 nt Target: | 5'-GCCGAAATAAAAGAAAAAGAT-3' | (SEQ ID NO: 3139) |
| AR-770 21 nt Target: | 5'-AAGAAAAAGATAATAACTCAG-3' | (SEQ ID NO: 3140) |
| AR-775 21 nt Target: | 5'-AAAGATAATAACTCAGTTCTT-3' | (SEQ ID NO: 3141) |
| AR-778 21 nt Target: | 5'-GATAATAACTCAGTTCTTATT-3' | (SEQ ID NO: 3142) |
| AR-833 21 nt Target: | 5'-TGGAGGATTTTGTTTTTTTCT-3' | (SEQ ID NO: 3143) |
| AR-838 21 nt Target: | 5'-GATTTGTTTTTTCTTTTAA-3' | (SEQ ID NO: 3144) |
| AR-844 21 nt Target: | 5'-GTTTTTTTCTTTTAAGATCTG-3' | (SEQ ID NO: 3145) |
| AR-864 21 nt Target: | 5'-GGGCATCTTTTGAATCTACCC-3' | (SEQ ID NO: 3146) |
| AR-971 21 nt Target: | 5'-CAGAGCGCTTTTTGCGTGGTT-3' | (SEQ ID NO: 3147) |
| AR-976 21 nt Target: | 5'-CGCTTTTTGCGTGGTTGCTCC-3' | (SEQ ID NO: 3148) |
| AR-1000 21 nt Target: | 5'-AAGTTTCCTTCTCTGGAGCTT-3' | (SEQ ID NO: 3149) |
| AR-1016 21 nt Target: | 5'-AGCTTCCCGCAGGTGGGCAGC-3' | (SEQ ID NO: 3150) |
| AR-1028 21 nt Target: | 5'-GTGGGCAGCTAGCTGCAGCGA-3' | (SEQ ID NO: 3151) |
| AR-1146 21 nt Target: | 5'-AAGTGCAGTTAGGGCTGGGAA-3' | (SEQ ID NO: 3152) |
| AR-1147 21 nt Target: | 5'-AGTGCAGTTAGGGCTGGGAAG-3' | (SEQ ID NO: 3153) |
| AR-1148 21 nt Target: | 5'-GTGCAGTTAGGGCTGGGAAGG-3' | (SEQ ID NO: 3154) |
| AR-1149 21 nt Target: | 5'-TGCAGTTAGGGCTGGGAAGGG-3' | (SEQ ID NO: 3155) |

TABLE 4-continued

DsiRNA Target Sequences (21mers)

| | | | |
|---|---|---|---|
| AR-1150 21 nt Target: | 5'-GCAGTTAGGGCTGGGAAGGGT-3' | (SEQ ID NO: 3156) |
| AR-1151 21 nt Target: | 5'-CAGTTAGGGCTGGGAAGGGTC-3' | (SEQ ID NO: 3157) |
| AR-1152 21 nt Target: | 5'-AGTTAGGGCTGGGAAGGGTCT-3' | (SEQ ID NO: 3158) |
| AR-1153 21 nt Target: | 5'-GTTAGGGCTGGGAAGGGTCTA-3' | (SEQ ID NO: 3159) |
| AR-1154 21 nt Target: | 5'-TTAGGGCTGGGAAGGGTCTAC-3' | (SEQ ID NO: 3160) |
| AR-1155 21 nt Target: | 5'-TAGGGCTGGGAAGGGTCTACC-3' | (SEQ ID NO: 3161) |
| AR-1156 21 nt Target: | 5'-AGGGCTGGGAAGGGTCTACCC-3' | (SEQ ID NO: 3162) |
| AR-1206 21 nt Target: | 5'-CTTTCCAGAATCTGTTCCAGA-3' | (SEQ ID NO: 3163) |
| AR-1207 21 nt Target: | 5'-TTTCCAGAATCTGTTCCAGAG-3' | (SEQ ID NO: 3164) |
| AR-1208 21 nt Target: | 5'-TTCCAGAATCTGTTCCAGAGC-3' | (SEQ ID NO: 3165) |
| AR-1209 21 nt Target: | 5'-TCCAGAATCTGTTCCAGAGCG-3' | (SEQ ID NO: 3166) |
| AR-1210 21 nt Target: | 5'-CCAGAATCTGTTCCAGAGCGT-3' | (SEQ ID NO: 3167) |
| AR-1211 21 nt Target: | 5'-CAGAATCTGTTCCAGAGCGTG-3' | (SEQ ID NO: 3168) |
| AR-1212 21 nt Target: | 5'-AGAATCTGTTCCAGAGCGTGC-3' | (SEQ ID NO: 3169) |
| AR-1213 21 nt Target: | 5'-GAATCTGTTCCAGAGCGTGCG-3' | (SEQ ID NO: 3170) |
| AR-1214 21 nt Target: | 5'-AATCTGTTCCAGAGCGTGCGC-3' | (SEQ ID NO: 3171) |
| AR-1215 21 nt Target: | 5'-ATCTGTTCCAGAGCGTGCGCG-3' | (SEQ ID NO: 3172) |
| AR-1216 21 nt Target: | 5'-TCTGTTCCAGAGCGTGCGCGA-3' | (SEQ ID NO: 3173) |
| AR-1217 21 nt Target: | 5'-CTGTTCCAGAGCGTGCGCGAA-3' | (SEQ ID NO: 3174) |
| AR-1218 21 nt Target: | 5'-TGTTCCAGAGCGTGCGCGAAG-3' | (SEQ ID NO: 3175) |
| AR-1292 21 nt Target: | 5'-GGCGCCAGTTTGCTGCTGCTG-3' | (SEQ ID NO: 3176) |
| AR-1301 21 nt Target: | 5'-TTGCTGCTGCTGCAGCAGCAG-3' | (SEQ ID NO: 3177) |
| AR-1533 21 nt Target: | 5'-GCGTCCCAGAGCCTGGAGCCG-3' | (SEQ ID NO: 3178) |
| AR-1572 21 nt Target: | 5'-GGCTGCCGCAGCAGCTGCCAG-3' | (SEQ ID NO: 3179) |
| AR-1578 21 nt Target: | 5'-CGCAGCAGCTGCCAGCACCTC-3' | (SEQ ID NO: 3180) |
| AR-1621 21 nt Target: | 5'-CCCATCCACGTTGTCCCTGCT-3' | (SEQ ID NO: 3181) |
| AR-1656 21 nt Target: | 5'-CCGGCTTAAGCAGCTGCTCCG-3' | (SEQ ID NO: 3182) |
| AR-1657 21 nt Target: | 5'-CGGCTTAAGCAGCTGCTCCGC-3' | (SEQ ID NO: 3183) |
| AR-1662 21 nt Target: | 5'-TAAGCAGCTGCTCCGCTGACC-3' | (SEQ ID NO: 3184) |
| AR-1712 21 nt Target: | 5'-ATGCAACTCCTTCAGCAACAG-3' | (SEQ ID NO: 3185) |
| AR-1832 21 nt Target: | 5'-ACCATTTCTGACAACGCCAAG-3' | (SEQ ID NO: 3186) |
| AR-1952 21 nt Target: | 5'-CCACTTTTGGGAGTTCCACCC-3' | (SEQ ID NO: 3187) |
| AR-2037 21 nt Target: | 5'-CAGGCAAGAGCACTGAAGATA-3' | (SEQ ID NO: 3188) |
| AR-2124 21 nt Target: | 5'-CTGGCAGCGCTGCAGCAGGGA-3' | (SEQ ID NO: 3189) |
| AR-2222 21 nt Target: | 5'-AGTCGCGACTACTACAACTTT-3' | (SEQ ID NO: 3190) |
| AR-2223 21 nt Target: | 5'-GTCGCGACTACTACAACTTTC-3' | (SEQ ID NO: 3191) |
| AR-2224 21 nt Target: | 5'-TCGCGACTACTACAACTTTCC-3' | (SEQ ID NO: 3192) |
| AR-2294 21 nt Target: | 5'-GCTCGCATCAAGCTGGAGAAC-3' | (SEQ ID NO: 3193) |
| AR-2317 21 nt Target: | 5'-GCTGGACTACGGCAGCGCCTG-3' | (SEQ ID NO: 3194) |

TABLE 4-continued

DsiRNA Target Sequences (21mers)

| | | | |
|---|---|---|---|
| AR-2318 21 nt Target: | 5'-CTGGACTACGGCAGCGCCTGG-3' | (SEQ ID NO: 3195) |
| AR-2319 21 nt Target: | 5'-TGGACTACGGCAGCGCCTGGG-3' | (SEQ ID NO: 3196) |
| AR-2320 21 nt Target: | 5'-GGACTACGGCAGCGCCTGGGC-3' | (SEQ ID NO: 3197) |
| AR-2386 21 nt Target: | 5'-TGGCGCGGGTGCAGCGGGACC-3' | (SEQ ID NO: 3198) |
| AR-2607 21 nt Target: | 5'-GGCTGGCGGGCCAGGAAAGCG-3' | (SEQ ID NO: 3199) |
| AR-2650 21 nt Target: | 5'-GTACCCTGGCGGCATGGTGAG-3' | (SEQ ID NO: 3200) |
| AR-2720 21 nt Target: | 5'-TGGATGGATAGCTACTCCGGA-3' | (SEQ ID NO: 3201) |
| AR-2808 21 nt Target: | 5'-CCCAGAAGACCTGCCTGATCT-3' | (SEQ ID NO: 3202) |
| AR-2809 21 nt Target: | 5'-CCAGAAGACCTGCCTGATCTG-3' | (SEQ ID NO: 3203) |
| AR-2810 21 nt Target: | 5'-CAGAAGACCTGCCTGATCTGT-3' | (SEQ ID NO: 3204) |
| AR-2811 21 nt Target: | 5'-AGAAGACCTGCCTGATCTGTG-3' | (SEQ ID NO: 3205) |
| AR-2812 21 nt Target: | 5'-GAAGACCTGCCTGATCTGTGG-3' | (SEQ ID NO: 3206) |
| AR-2813 21 nt Target: | 5'-AAGACCTGCCTGATCTGTGGA-3' | (SEQ ID NO: 3207) |
| AR-2814 21 nt Target: | 5'-AGACCTGCCTGATCTGTGGAG-3' | (SEQ ID NO: 3208) |
| AR-2815 21 nt Target: | 5'-GACCTGCCTGATCTGTGGAGA-3' | (SEQ ID NO: 3209) |
| AR-2816 21 nt Target: | 5'-ACCTGCCTGATCTGTGGAGAT-3' | (SEQ ID NO: 3210) |
| AR-2817 21 nt Target: | 5'-CCTGCCTGATCTGTGGAGATG-3' | (SEQ ID NO: 3211) |
| AR-2818 21 nt Target: | 5'-CTGCCTGATCTGTGGAGATGA-3' | (SEQ ID NO: 3212) |
| AR-2819 21 nt Target: | 5'-TGCCTGATCTGTGGAGATGAA-3' | (SEQ ID NO: 3213) |
| AR-2820 21 nt Target: | 5'-GCCTGATCTGTGGAGATGAAG-3' | (SEQ ID NO: 3214) |
| AR-2821 21 nt Target: | 5'-CCTGATCTGTGGAGATGAAGC-3' | (SEQ ID NO: 3215) |
| AR-2822 21 nt Target: | 5'-CTGATCTGTGGAGATGAAGCT-3' | (SEQ ID NO: 3216) |
| AR-2823 21 nt Target: | 5'-TGATCTGTGGAGATGAAGCTT-3' | (SEQ ID NO: 3217) |
| AR-2824 21 nt Target: | 5'-GATCTGTGGAGATGAAGCTTC-3' | (SEQ ID NO: 3218) |
| AR-2825 21 nt Target: | 5'-ATCTGTGGAGATGAAGCTTCT-3' | (SEQ ID NO: 3219) |
| AR-2826 21 nt Target: | 5'-TCTGTGGAGATGAAGCTTCTG-3' | (SEQ ID NO: 3220) |
| AR-2827 21 nt Target: | 5'-CTGTGGAGATGAAGCTTCTGG-3' | (SEQ ID NO: 3221) |
| AR-2840 21 nt Target: | 5'-GCTTCTGGGTGTCACTATGGA-3' | (SEQ ID NO: 3222) |
| AR-2857 21 nt Target: | 5'-TGGAGCTCTCACATGTGGAAG-3' | (SEQ ID NO: 3223) |
| AR-2874 21 nt Target: | 5'-GAAGCTGCAAGGTCTTCTTCA-3' | (SEQ ID NO: 3224) |
| AR-2875 21 nt Target: | 5'-AAGCTGCAAGGTCTTCTTCAA-3' | (SEQ ID NO: 3225) |
| AR-2876 21 nt Target: | 5'-AGCTGCAAGGTCTTCTTCAAA-3' | (SEQ ID NO: 3226) |
| AR-2877 21 nt Target: | 5'-GCTGCAAGGTCTTCTTCAAAA-3' | (SEQ ID NO: 3227) |
| AR-2878 21 nt Target: | 5'-CTGCAAGGTCTTCTTCAAAAG-3' | (SEQ ID NO: 3228) |
| AR-2879 21 nt Target: | 5'-TGCAAGGTCTTCTTCAAAAGA-3' | (SEQ ID NO: 3229) |
| AR-2880 21 nt Target: | 5'-GCAAGGTCTTCTTCAAAAGAG-3' | (SEQ ID NO: 3230) |
| AR-2881 21 nt Target: | 5'-CAAGGTCTTCTTCAAAAGAGC-3' | (SEQ ID NO: 3231) |
| AR-2882 21 nt Target: | 5'-AAGGTCTTCTTCAAAAGAGCC-3' | (SEQ ID NO: 3232) |
| AR-2883 21 nt Target: | 5'-AGGTCTTCTTCAAAAGAGCCG-3' | (SEQ ID NO: 3233) |

TABLE 4-continued

DsiRNA Target Sequences (21mers)

| | | |
|---|---|---|
| AR-2884 21 nt Target: | 5'-GGTCTTCTTCAAAAGAGCCGC-3' | (SEQ ID NO: 3234) |
| AR-2885 21 nt Target: | 5'-GTCTTCTTCAAAAGAGCCGCT-3' | (SEQ ID NO: 3235) |
| AR-2886 21 nt Target: | 5'-TCTTCTTCAAAAGAGCCGCTG-3' | (SEQ ID NO: 3236) |
| AR-2887 21 nt Target: | 5'-CTTCTTCAAAAGAGCCGCTGA-3' | (SEQ ID NO: 3237) |
| AR-2888 21 nt Target: | 5'-TTCTTCAAAAGAGCCGCTGAA-3' | (SEQ ID NO: 3238) |
| AR-2889 21 nt Target: | 5'-TCTTCAAAAGAGCCGCTGAAG-3' | (SEQ ID NO: 3239) |
| AR-2890 21 nt Target: | 5'-CTTCAAAAGAGCCGCTGAAGG-3' | (SEQ ID NO: 3240) |
| AR-2891 21 nt Target: | 5'-TTCAAAAGAGCCGCTGAAGGG-3' | (SEQ ID NO: 3241) |
| AR-2892 21 nt Target: | 5'-TCAAAAGAGCCGCTGAAGGGA-3' | (SEQ ID NO: 3242) |
| AR-2893 21 nt Target: | 5'-CAAAAGAGCCGCTGAAGGGAA-3' | (SEQ ID NO: 3243) |
| AR-2894 21 nt Target: | 5'-AAAAGAGCCGCTGAAGGGAAA-3' | (SEQ ID NO: 3244) |
| AR-2895 21 nt Target: | 5'-AAAGAGCCGCTGAAGGGAAAC-3' | (SEQ ID NO: 3245) |
| AR-2896 21 nt Target: | 5'-AAGAGCCGCTGAAGGGAAACA-3' | (SEQ ID NO: 3246) |
| AR-2897 21 nt Target: | 5'-AGAGCCGCTGAAGGGAAACAG-3' | (SEQ ID NO: 3247) |
| AR-2898 21 nt Target: | 5'-GAGCCGCTGAAGGGAAACAGA-3' | (SEQ ID NO: 3248) |
| AR-2899 21 nt Target: | 5'-AGCCGCTGAAGGGAAACAGAA-3' | (SEQ ID NO: 3249) |
| AR-2901 21 nt Target: | 5'-CCGCTGAAGGGAAACAGAAGT-3' | (SEQ ID NO: 3250) |
| AR-2902 21 nt Target: | 5'-CGCTGAAGGGAAACAGAAGTA-3' | (SEQ ID NO: 3251) |
| AR-2923 21 nt Target: | 5'-CCTGTGCGCCAGCAGAAATGA-3' | (SEQ ID NO: 3252) |
| AR-2934 21 nt Target: | 5'-GCAGAAATGATTGCACTATTG-3' | (SEQ ID NO: 3253) |
| AR-2939 21 nt Target: | 5'-AATGATTGCACTATTGATAAA-3' | (SEQ ID NO: 3254) |
| AR-2947 21 nt Target: | 5'-CACTATTGATAAATTCCGAAG-3' | (SEQ ID NO: 3255) |
| AR-2991 21 nt Target: | 5'-TTCGGAAATGTTATGAAGCAG-3' | (SEQ ID NO: 3256) |
| AR-2992 21 nt Target: | 5'-TCGGAAATGTTATGAAGCAGG-3' | (SEQ ID NO: 3257) |
| AR-2993 21 nt Target: | 5'-CGGAAATGTTATGAAGCAGGG-3' | (SEQ ID NO: 3258) |
| AR-2994 21 nt Target: | 5'-GGAAATGTTATGAAGCAGGGA-3' | (SEQ ID NO: 3259) |
| AR-2995 21 nt Target: | 5'-GAAATGTTATGAAGCAGGGAT-3' | (SEQ ID NO: 3260) |
| AR-2996 21 nt Target: | 5'-AAATGTTATGAAGCAGGGATG-3' | (SEQ ID NO: 3261) |
| AR-2997 21 nt Target: | 5'-AATGTTATGAAGCAGGGATGA-3' | (SEQ ID NO: 3262) |
| AR-2998 21 nt Target: | 5'-ATGTTATGAAGCAGGGATGAC-3' | (SEQ ID NO: 3263) |
| AR-2999 21 nt Target: | 5'-TGTTATGAAGCAGGGATGACT-3' | (SEQ ID NO: 3264) |
| AR-3000 21 nt Target: | 5'-GTTATGAAGCAGGGATGACTC-3' | (SEQ ID NO: 3265) |
| AR-3001 21 nt Target: | 5'-TTATGAAGCAGGGATGACTCT-3' | (SEQ ID NO: 3266) |
| AR-3002 21 nt Target: | 5'-TATGAAGCAGGGATGACTCTG-3' | (SEQ ID NO: 3267) |
| AR-3003 21 nt Target: | 5'-ATGAAGCAGGGATGACTCTGG-3' | (SEQ ID NO: 3268) |
| AR-3004 21 nt Target: | 5'-TGAAGCAGGGATGACTCTGGG-3' | (SEQ ID NO: 3269) |
| AR-3005 21 nt Target: | 5'-GAAGCAGGGATGACTCTGGGA-3' | (SEQ ID NO: 3270) |
| AR-3006 21 nt Target: | 5'-AAGCAGGGATGACTCTGGGAG-3' | (SEQ ID NO: 3271) |
| AR-3007 21 nt Target: | 5'-AGCAGGGATGACTCTGGGAGC-3' | (SEQ ID NO: 3272) |

TABLE 4-continued

DsiRNA Target Sequences (21mers)

| | | | |
|---|---|---|---|
| AR-3035 21 nt Target: | 5'-CTGAAGAAACTTGGTAATCTG-3' | (SEQ ID NO: 3273) |
| AR-3054 21 nt Target: | 5'-TGAAACTACAGGAGGAAGGAG-3' | (SEQ ID NO: 3274) |
| AR-3055 21 nt Target: | 5'-GAAACTACAGGAGGAAGGAGA-3' | (SEQ ID NO: 3275) |
| AR-3131 21 nt Target: | 5'-CACATTGAAGGCTATGAATGT-3' | (SEQ ID NO: 3276) |
| AR-3132 21 nt Target: | 5'-ACATTGAAGGCTATGAATGTC-3' | (SEQ ID NO: 3277) |
| AR-3133 21 nt Target: | 5'-CATTGAAGGCTATGAATGTCA-3' | (SEQ ID NO: 3278) |
| AR-3134 21 nt Target: | 5'-ATTGAAGGCTATGAATGTCAG-3' | (SEQ ID NO: 3279) |
| AR-3135 21 nt Target: | 5'-TTGAAGGCTATGAATGTCAGC-3' | (SEQ ID NO: 3280) |
| AR-3136 21 nt Target: | 5'-TGAAGGCTATGAATGTCAGCC-3' | (SEQ ID NO: 3281) |
| AR-3168 21 nt Target: | 5'-ATGTCCTGGAAGCCATTGAGC-3' | (SEQ ID NO: 3282) |
| AR-3169 21 nt Target: | 5'-TGTCCTGGAAGCCATTGAGCC-3' | (SEQ ID NO: 3283) |
| AR-3170 21 nt Target: | 5'-GTCCTGGAAGCCATTGAGCCA-3' | (SEQ ID NO: 3284) |
| AR-3171 21 nt Target: | 5'-TCCTGGAAGCCATTGAGCCAG-3' | (SEQ ID NO: 3285) |
| AR-3172 21 nt Target: | 5'-CCTGGAAGCCATTGAGCCAGG-3' | (SEQ ID NO: 3286) |
| AR-3219 21 nt Target: | 5'-ACCAGCCCGACTCCTTTGCAG-3' | (SEQ ID NO: 3287) |
| AR-3225 21 nt Target: | 5'-CCGACTCCTTTGCAGCCTTGC-3' | (SEQ ID NO: 3288) |
| AR-3235 21 nt Target: | 5'-TGCAGCCTTGCTCTCTAGCCT-3' | (SEQ ID NO: 3289) |
| AR-3285 21 nt Target: | 5'-ACGTGGTCAAGTGGGCCAAGG-3' | (SEQ ID NO: 3290) |
| AR-3286 21 nt Target: | 5'-CGTGGTCAAGTGGGCCAAGGC-3' | (SEQ ID NO: 3291) |
| AR-3287 21 nt Target: | 5'-GTGGTCAAGTGGGCCAAGGCC-3' | (SEQ ID NO: 3292) |
| AR-3288 21 nt Target: | 5'-TGGTCAAGTGGGCCAAGGCCT-3' | (SEQ ID NO: 3293) |
| AR-3289 21 nt Target: | 5'-GGTCAAGTGGGCCAAGGCCTT-3' | (SEQ ID NO: 3294) |
| AR-3290 21 nt Target: | 5'-GTCAAGTGGGCCAAGGCCTTG-3' | (SEQ ID NO: 3295) |
| AR-3291 21 nt Target: | 5'-TCAAGTGGGCCAAGGCCTTGC-3' | (SEQ ID NO: 3296) |
| AR-3292 21 nt Target: | 5'-CAAGTGGGCCAAGGCCTTGCC-3' | (SEQ ID NO: 3297) |
| AR-3293 21 nt Target: | 5'-AAGTGGGCCAAGGCCTTGCCT-3' | (SEQ ID NO: 3298) |
| AR-3294 21 nt Target: | 5'-AGTGGGCCAAGGCCTTGCCTG-3' | (SEQ ID NO: 3299) |
| AR-3295 21 nt Target: | 5'-GTGGGCCAAGGCCTTGCCTGG-3' | (SEQ ID NO: 3300) |
| AR-3296 21 nt Target: | 5'-TGGGCCAAGGCCTTGCCTGGC-3' | (SEQ ID NO: 3301) |
| AR-3297 21 nt Target: | 5'-GGGCCAAGGCCTTGCCTGGCT-3' | (SEQ ID NO: 3302) |
| AR-3298 21 nt Target: | 5'-GGCCAAGGCCTTGCCTGGCTT-3' | (SEQ ID NO: 3303) |
| AR-3299 21 nt Target: | 5'-GCCAAGGCCTTGCCTGGCTTC-3' | (SEQ ID NO: 3304) |
| AR-3300 21 nt Target: | 5'-CCAAGGCCTTGCCTGGCTTCC-3' | (SEQ ID NO: 3305) |
| AR-3301 21 nt Target: | 5'-CAAGGCCTTGCCTGGCTTCCG-3' | (SEQ ID NO: 3306) |
| AR-3302 21 nt Target: | 5'-AAGGCCTTGCCTGGCTTCCGC-3' | (SEQ ID NO: 3307) |
| AR-3303 21 nt Target: | 5'-AGGCCTTGCCTGGCTTCCGCA-3' | (SEQ ID NO: 3308) |
| AR-3304 21 nt Target: | 5'-GGCCTTGCCTGGCTTCCGCAA-3' | (SEQ ID NO: 3309) |
| AR-3305 21 nt Target: | 5'-GCCTTGCCTGGCTTCCGCAAC-3' | (SEQ ID NO: 3310) |
| AR-3306 21 nt Target: | 5'-CCTTGCCTGGCTTCCGCAACT-3' | (SEQ ID NO: 3311) |

TABLE 4-continued

DsiRNA Target Sequences (21mers)

| | | | |
|---|---|---|---|
| AR-3307 21 nt Target: | 5'-CTTGCCTGGCTTCCGCAACTT-3' | (SEQ ID NO: 3312) |
| AR-3408 21 nt Target: | 5'-CCAATGTCAACTCCAGGATGC-3' | (SEQ ID NO: 3313) |
| AR-3409 21 nt Target: | 5'-CAATGTCAACTCCAGGATGCT-3' | (SEQ ID NO: 3314) |
| AR-3410 21 nt Target: | 5'-AATGTCAACTCCAGGATGCTC-3' | (SEQ ID NO: 3315) |
| AR-3411 21 nt Target: | 5'-ATGTCAACTCCAGGATGCTCT-3' | (SEQ ID NO: 3316) |
| AR-3412 21 nt Target: | 5'-TGTCAACTCCAGGATGCTCTA-3' | (SEQ ID NO: 3317) |
| AR-3413 21 nt Target: | 5'-GTCAACTCCAGGATGCTCTAC-3' | (SEQ ID NO: 3318) |
| AR-3414 21 nt Target: | 5'-TCAACTCCAGGATGCTCTACT-3' | (SEQ ID NO: 3319) |
| AR-3445 21 nt Target: | 5'-TCTGGTTTTCAATGAGTACCG-3' | (SEQ ID NO: 3320) |
| AR-3446 21 nt Target: | 5'-CTGGTTTTCAATGAGTACCGC-3' | (SEQ ID NO: 3321) |
| AR-3447 21 nt Target: | 5'-TGGTTTTCAATGAGTACCGCA-3' | (SEQ ID NO: 3322) |
| AR-3448 21 nt Target: | 5'-GGTTTTCAATGAGTACCGCAT-3' | (SEQ ID NO: 3323) |
| AR-3449 21 nt Target: | 5'-GTTTTCAATGAGTACCGCATG-3' | (SEQ ID NO: 3324) |
| AR-3450 21 nt Target: | 5'-TTTTCAATGAGTACCGCATGC-3' | (SEQ ID NO: 3325) |
| AR-3451 21 nt Target: | 5'-TTTCAATGAGTACCGCATGCA-3' | (SEQ ID NO: 3326) |
| AR-3452 21 nt Target: | 5'-TTCAATGAGTACCGCATGCAC-3' | (SEQ ID NO: 3327) |
| AR-3453 21 nt Target: | 5'-TCAATGAGTACCGCATGCACA-3' | (SEQ ID NO: 3328) |
| AR-3454 21 nt Target: | 5'-CAATGAGTACCGCATGCACAA-3' | (SEQ ID NO: 3329) |
| AR-3455 21 nt Target: | 5'-AATGAGTACCGCATGCACAAG-3' | (SEQ ID NO: 3330) |
| AR-3456 21 nt Target: | 5'-ATGAGTACCGCATGCACAAGT-3' | (SEQ ID NO: 3331) |
| AR-3457 21 nt Target: | 5'-TGAGTACCGCATGCACAAGTC-3' | (SEQ ID NO: 3332) |
| AR-3513 21 nt Target: | 5'-TCTCTCAAGAGTTTGGATGGC-3' | (SEQ ID NO: 3333) |
| AR-3514 21 nt Target: | 5'-CTCTCAAGAGTTTGGATGGCT-3' | (SEQ ID NO: 3334) |
| AR-3515 21 nt Target: | 5'-TCTCAAGAGTTTGGATGGCTC-3' | (SEQ ID NO: 3335) |
| AR-3516 21 nt Target: | 5'-CTCAAGAGTTTGGATGGCTCC-3' | (SEQ ID NO: 3336) |
| AR-3517 21 nt Target: | 5'-TCAAGAGTTTGGATGGCTCCA-3' | (SEQ ID NO: 3337) |
| AR-3518 21 nt Target: | 5'-CAAGAGTTTGGATGGCTCCAA-3' | (SEQ ID NO: 3338) |
| AR-3519 21 nt Target: | 5'-AAGAGTTTGGATGGCTCCAAA-3' | (SEQ ID NO: 3339) |
| AR-3546 21 nt Target: | 5'-CCCAGGAATTCCTGTGCATGA-3' | (SEQ ID NO: 3340) |
| AR-3547 21 nt Target: | 5'-CCAGGAATTCCTGTGCATGAA-3' | (SEQ ID NO: 3341) |
| AR-3548 21 nt Target: | 5'-CAGGAATTCCTGTGCATGAAA-3' | (SEQ ID NO: 3342) |
| AR-3549 21 nt Target: | 5'-AGGAATTCCTGTGCATGAAAG-3' | (SEQ ID NO: 3343) |
| AR-3550 21 nt Target: | 5'-GGAATTCCTGTGCATGAAAGC-3' | (SEQ ID NO: 3344) |
| AR-3551 21 nt Target: | 5'-GAATTCCTGTGCATGAAAGCA-3' | (SEQ ID NO: 3345) |
| AR-3552 21 nt Target: | 5'-AATTCCTGTGCATGAAAGCAC-3' | (SEQ ID NO: 3346) |
| AR-3553 21 nt Target: | 5'-ATTCCTGTGCATGAAAGCACT-3' | (SEQ ID NO: 3347) |
| AR-3554 21 nt Target: | 5'-TTCCTGTGCATGAAAGCACTG-3' | (SEQ ID NO: 3348) |
| AR-3555 21 nt Target: | 5'-TCCTGTGCATGAAAGCACTGC-3' | (SEQ ID NO: 3349) |
| AR-3556 21 nt Target: | 5'-CCTGTGCATGAAAGCACTGCT-3' | (SEQ ID NO: 3350) |

TABLE 4-continued

DsiRNA Target Sequences (21mers)

| | | | |
|---|---|---|---|
| AR-3576 | 21 nt Target: | 5'-TACTCTTCAGCATTATTCCAG-3' | (SEQ ID NO: 3351) |
| AR-3577 | 21 nt Target: | 5'-ACTCTTCAGCATTATTCCAGT-3' | (SEQ ID NO: 3352) |
| AR-3578 | 21 nt Target: | 5'-CTCTTCAGCATTATTCCAGTG-3' | (SEQ ID NO: 3353) |
| AR-3579 | 21 nt Target: | 5'-TCTTCAGCATTATTCCAGTGG-3' | (SEQ ID NO: 3354) |
| AR-3580 | 21 nt Target: | 5'-CTTCAGCATTATTCCAGTGGA-3' | (SEQ ID NO: 3355) |
| AR-3581 | 21 nt Target: | 5'-TTCAGCATTATTCCAGTGGAT-3' | (SEQ ID NO: 3356) |
| AR-3582 | 21 nt Target: | 5'-TCAGCATTATTCCAGTGGATG-3' | (SEQ ID NO: 3357) |
| AR-3583 | 21 nt Target: | 5'-CAGCATTATTCCAGTGGATGG-3' | (SEQ ID NO: 3358) |
| AR-3584 | 21 nt Target: | 5'-AGCATTATTCCAGTGGATGGG-3' | (SEQ ID NO: 3359) |
| AR-3585 | 21 nt Target: | 5'-GCATTATTCCAGTGGATGGGC-3' | (SEQ ID NO: 3360) |
| AR-3586 | 21 nt Target: | 5'-CATTATTCCAGTGGATGGGCT-3' | (SEQ ID NO: 3361) |
| AR-3587 | 21 nt Target: | 5'-ATTATTCCAGTGGATGGGCTG-3' | (SEQ ID NO: 3362) |
| AR-3588 | 21 nt Target: | 5'-TTATTCCAGTGGATGGGCTGA-3' | (SEQ ID NO: 3363) |
| AR-3589 | 21 nt Target: | 5'-TATTCCAGTGGATGGGCTGAA-3' | (SEQ ID NO: 3364) |
| AR-3590 | 21 nt Target: | 5'-ATTCCAGTGGATGGGCTGAAA-3' | (SEQ ID NO: 3365) |
| AR-3591 | 21 nt Target: | 5'-TTCCAGTGGATGGGCTGAAAA-3' | (SEQ ID NO: 3366) |
| AR-3592 | 21 nt Target: | 5'-TCCAGTGGATGGGCTGAAAAA-3' | (SEQ ID NO: 3367) |
| AR-3593 | 21 nt Target: | 5'-CCAGTGGATGGGCTGAAAAAT-3' | (SEQ ID NO: 3368) |
| AR-3594 | 21 nt Target: | 5'-CAGTGGATGGGCTGAAAAATC-3' | (SEQ ID NO: 3369) |
| AR-3595 | 21 nt Target: | 5'-AGTGGATGGGCTGAAAAATCA-3' | (SEQ ID NO: 3370) |
| AR-3596 | 21 nt Target: | 5'-GTGGATGGGCTGAAAAATCAA-3' | (SEQ ID NO: 3371) |
| AR-3597 | 21 nt Target: | 5'-TGGATGGGCTGAAAAATCAAA-3' | (SEQ ID NO: 3372) |
| AR-3598 | 21 nt Target: | 5'-GGATGGGCTGAAAAATCAAAA-3' | (SEQ ID NO: 3373) |
| AR-3599 | 21 nt Target: | 5'-GATGGGCTGAAAAATCAAAAA-3' | (SEQ ID NO: 3374) |
| AR-3600 | 21 nt Target: | 5'-ATGGGCTGAAAAATCAAAAAT-3' | (SEQ ID NO: 3375) |
| AR-3601 | 21 nt Target: | 5'-TGGGCTGAAAAATCAAAAATT-3' | (SEQ ID NO: 3376) |
| AR-3602 | 21 nt Target: | 5'-GGGCTGAAAAATCAAAAATTC-3' | (SEQ ID NO: 3377) |
| AR-3603 | 21 nt Target: | 5'-GGCTGAAAAATCAAAAATTCT-3' | (SEQ ID NO: 3378) |
| AR-3604 | 21 nt Target: | 5'-GCTGAAAAATCAAAAATTCTT-3' | (SEQ ID NO: 3379) |
| AR-3605 | 21 nt Target: | 5'-CTGAAAAATCAAAAATTCTTT-3' | (SEQ ID NO: 3380) |
| AR-3606 | 21 nt Target: | 5'-TGAAAAATCAAAAATTCTTTG-3' | (SEQ ID NO: 3381) |
| AR-3608 | 21 nt Target: | 5'-AAAAATCAAAAATTCTTTGAT-3' | (SEQ ID NO: 3382) |
| AR-3609 | 21 nt Target: | 5'-AAAATCAAAAATTCTTTGATG-3' | (SEQ ID NO: 3383) |
| AR-3610 | 21 nt Target: | 5'-AAATCAAAAATTCTTTGATGA-3' | (SEQ ID NO: 3384) |
| AR-3611 | 21 nt Target: | 5'-AATCAAAAATTCTTTGATGAA-3' | (SEQ ID NO: 3385) |
| AR-3612 | 21 nt Target: | 5'-ATCAAAAATTCTTTGATGAAC-3' | (SEQ ID NO: 3386) |
| AR-3613 | 21 nt Target: | 5'-TCAAAAATTCTTTGATGAACT-3' | (SEQ ID NO: 3387) |
| AR-3614 | 21 nt Target: | 5'-CAAAAATTCTTTGATGAACTT-3' | (SEQ ID NO: 3388) |
| AR-3615 | 21 nt Target: | 5'-AAAAATTCTTTGATGAACTTC-3' | (SEQ ID NO: 3389) |

TABLE 4-continued

DsiRNA Target Sequences (21mers)

| | | | |
|---|---|---|---|
| AR-3616 21 nt Target: | 5'-AAAATTCTTTGATGAACTTCG-3' | (SEQ ID NO: 3390) |
| AR-3617 21 nt Target: | 5'-AAATTCTTTGATGAACTTCGA-3' | (SEQ ID NO: 3391) |
| AR-3618 21 nt Target: | 5'-AATTCTTTGATGAACTTCGAA-3' | (SEQ ID NO: 3392) |
| AR-3619 21 nt Target: | 5'-ATTCTTTGATGAACTTCGAAT-3' | (SEQ ID NO: 3393) |
| AR-3620 21 nt Target: | 5'-TTCTTTGATGAACTTCGAATG-3' | (SEQ ID NO: 3394) |
| AR-3621 21 nt Target: | 5'-TCTTTGATGAACTTCGAATGA-3' | (SEQ ID NO: 3395) |
| AR-3622 21 nt Target: | 5'-CTTTGATGAACTTCGAATGAA-3' | (SEQ ID NO: 3396) |
| AR-3623 21 nt Target: | 5'-TTTGATGAACTTCGAATGAAC-3' | (SEQ ID NO: 3397) |
| AR-3624 21 nt Target: | 5'-TTGATGAACTTCGAATGAACT-3' | (SEQ ID NO: 3398) |
| AR-3625 21 nt Target: | 5'-TGATGAACTTCGAATGAACTA-3' | (SEQ ID NO: 3399) |
| AR-3626 21 nt Target: | 5'-GATGAACTTCGAATGAACTAC-3' | (SEQ ID NO: 3400) |
| AR-3627 21 nt Target: | 5'-ATGAACTTCGAATGAACTACA-3' | (SEQ ID NO: 3401) |
| AR-3628 21 nt Target: | 5'-TGAACTTCGAATGAACTACAT-3' | (SEQ ID NO: 3402) |
| AR-3629 21 nt Target: | 5'-GAACTTCGAATGAACTACATC-3' | (SEQ ID NO: 3403) |
| AR-3630 21 nt Target: | 5'-AACTTCGAATGAACTACATCA-3' | (SEQ ID NO: 3404) |
| AR-3631 21 nt Target: | 5'-ACTTCGAATGAACTACATCAA-3' | (SEQ ID NO: 3405) |
| AR-3632 21 nt Target: | 5'-CTTCGAATGAACTACATCAAG-3' | (SEQ ID NO: 3406) |
| AR-3633 21 nt Target: | 5'-TTCGAATGAACTACATCAAGG-3' | (SEQ ID NO: 3407) |
| AR-3634 21 nt Target: | 5'-TCGAATGAACTACATCAAGGA-3' | (SEQ ID NO: 3408) |
| AR-3635 21 nt Target: | 5'-CGAATGAACTACATCAAGGAA-3' | (SEQ ID NO: 3409) |
| AR-3636 21 nt Target: | 5'-GAATGAACTACATCAAGGAAC-3' | (SEQ ID NO: 3410) |
| AR-3637 21 nt Target: | 5'-AATGAACTACATCAAGGAACT-3' | (SEQ ID NO: 3411) |
| AR-3638 21 nt Target: | 5'-ATGAACTACATCAAGGAACTC-3' | (SEQ ID NO: 3412) |
| AR-3639 21 nt Target: | 5'-TGAACTACATCAAGGAACTCG-3' | (SEQ ID NO: 3413) |
| AR-3640 21 nt Target: | 5'-GAACTACATCAAGGAACTCGA-3' | (SEQ ID NO: 3414) |
| AR-3641 21 nt Target: | 5'-AACTACATCAAGGAACTCGAT-3' | (SEQ ID NO: 3415) |
| AR-3642 21 nt Target: | 5'-ACTACATCAAGGAACTCGATC-3' | (SEQ ID NO: 3416) |
| AR-3643 21 nt Target: | 5'-CTACATCAAGGAACTCGATCG-3' | (SEQ ID NO: 3417) |
| AR-3663 21 nt Target: | 5'-GTATCATTGCATGCAAAAGAA-3' | (SEQ ID NO: 3418) |
| AR-3664 21 nt Target: | 5'-TATCATTGCATGCAAAAGAAA-3' | (SEQ ID NO: 3419) |
| AR-3684 21 nt Target: | 5'-AAAATCCCACATCCTGCTCAA-3' | (SEQ ID NO: 3420) |
| AR-3685 21 nt Target: | 5'-AAATCCCACATCCTGCTCAAG-3' | (SEQ ID NO: 3421) |
| AR-3705 21 nt Target: | 5'-GACGCTTCTACCAGCTCACCA-3' | (SEQ ID NO: 3422) |
| AR-3706 21 nt Target: | 5'-ACGCTTCTACCAGCTCACCAA-3' | (SEQ ID NO: 3423) |
| AR-3707 21 nt Target: | 5'-CGCTTCTACCAGCTCACCAAG-3' | (SEQ ID NO: 3424) |
| AR-3708 21 nt Target: | 5'-GCTTCTACCAGCTCACCAAGC-3' | (SEQ ID NO: 3425) |
| AR-3709 21 nt Target: | 5'-CTTCTACCAGCTCACCAAGCT-3' | (SEQ ID NO: 3426) |
| AR-3710 21 nt Target: | 5'-TTCTACCAGCTCACCAAGCTC-3' | (SEQ ID NO: 3427) |
| AR-3711 21 nt Target: | 5'-TCTACCAGCTCACCAAGCTCC-3' | (SEQ ID NO: 3428) |

TABLE 4-continued

DsiRNA Target Sequences (21mers)

| | | | |
|---|---|---|---|
| AR-3712 21 nt Target: | 5'-CTACCAGCTCACCAAGCTCCT-3' | (SEQ ID NO: 3429) |
| AR-3713 21 nt Target: | 5'-TACCAGCTCACCAAGCTCCTG-3' | (SEQ ID NO: 3430) |
| AR-3714 21 nt Target: | 5'-ACCAGCTCACCAAGCTCCTGG-3' | (SEQ ID NO: 3431) |
| AR-3715 21 nt Target: | 5'-CCAGCTCACCAAGCTCCTGGA-3' | (SEQ ID NO: 3432) |
| AR-3717 21 nt Target: | 5'-AGCTCACCAAGCTCCTGGACT-3' | (SEQ ID NO: 3433) |
| AR-3726 21 nt Target: | 5'-AGCTCCTGGACTCCGTGCAGC-3' | (SEQ ID NO: 3434) |
| AR-3737 21 nt Target: | 5'-TCCGTGCAGCCTATTGCGAGA-3' | (SEQ ID NO: 3435) |
| AR-3753 21 nt Target: | 5'-CGAGAGAGCTGCATCAGTTCA-3' | (SEQ ID NO: 3436) |
| AR-3754 21 nt Target: | 5'-GAGAGAGCTGCATCAGTTCAC-3' | (SEQ ID NO: 3437) |
| AR-3755 21 nt Target: | 5'-AGAGAGCTGCATCAGTTCACT-3' | (SEQ ID NO: 3438) |
| AR-3756 21 nt Target: | 5'-GAGAGCTGCATCAGTTCACTT-3' | (SEQ ID NO: 3439) |
| AR-3757 21 nt Target: | 5'-AGAGCTGCATCAGTTCACTTT-3' | (SEQ ID NO: 3440) |
| AR-3758 21 nt Target: | 5'-GAGCTGCATCAGTTCACTTTT-3' | (SEQ ID NO: 3441) |
| AR-3759 21 nt Target: | 5'-AGCTGCATCAGTTCACTTTTG-3' | (SEQ ID NO: 3442) |
| AR-3760 21 nt Target: | 5'-GCTGCATCAGTTCACTTTTGA-3' | (SEQ ID NO: 3443) |
| AR-3761 21 nt Target: | 5'-CTGCATCAGTTCACTTTTGAC-3' | (SEQ ID NO: 3444) |
| AR-3762 21 nt Target: | 5'-TGCATCAGTTCACTTTTGACC-3' | (SEQ ID NO: 3445) |
| AR-3763 21 nt Target: | 5'-GCATCAGTTCACTTTTGACCT-3' | (SEQ ID NO: 3446) |
| AR-3764 21 nt Target: | 5'-CATCAGTTCACTTTTGACCTG-3' | (SEQ ID NO: 3447) |
| AR-3765 21 nt Target: | 5'-ATCAGTTCACTTTTGACCTGC-3' | (SEQ ID NO: 3448) |
| AR-3766 21 nt Target: | 5'-TCAGTTCACTTTTGACCTGCT-3' | (SEQ ID NO: 3449) |
| AR-3767 21 nt Target: | 5'-CAGTTCACTTTTGACCTGCTA-3' | (SEQ ID NO: 3450) |
| AR-3768 21 nt Target: | 5'-AGTTCACTTTTGACCTGCTAA-3' | (SEQ ID NO: 3451) |
| AR-3769 21 nt Target: | 5'-GTTCACTTTTGACCTGCTAAT-3' | (SEQ ID NO: 3452) |
| AR-3770 21 nt Target: | 5'-TTCACTTTTGACCTGCTAATC-3' | (SEQ ID NO: 3453) |
| AR-3771 21 nt Target: | 5'-TCACTTTTGACCTGCTAATCA-3' | (SEQ ID NO: 3454) |
| AR-3772 21 nt Target: | 5'-CACTTTTGACCTGCTAATCAA-3' | (SEQ ID NO: 3455) |
| AR-3773 21 nt Target: | 5'-ACTTTTGACCTGCTAATCAAG-3' | (SEQ ID NO: 3456) |
| AR-3798 21 nt Target: | 5'-ACATGGTGAGCGTGGACTTTC-3' | (SEQ ID NO: 3457) |
| AR-3799 21 nt Target: | 5'-CATGGTGAGCGTGGACTTTCC-3' | (SEQ ID NO: 3458) |
| AR-3819 21 nt Target: | 5'-CGGAAATGATGGCAGAGATCA-3' | (SEQ ID NO: 3459) |
| AR-3820 21 nt Target: | 5'-GGAAATGATGGCAGAGATCAT-3' | (SEQ ID NO: 3460) |
| AR-3821 21 nt Target: | 5'-GAAATGATGGCAGAGATCATC-3' | (SEQ ID NO: 3461) |
| AR-3822 21 nt Target: | 5'-AAATGATGGCAGAGATCATCT-3' | (SEQ ID NO: 3462) |
| AR-3823 21 nt Target: | 5'-AATGATGGCAGAGATCATCTC-3' | (SEQ ID NO: 3463) |
| AR-3824 21 nt Target: | 5'-ATGATGGCAGAGATCATCTCT-3' | (SEQ ID NO: 3464) |
| AR-3825 21 nt Target: | 5'-TGATGGCAGAGATCATCTCTG-3' | (SEQ ID NO: 3465) |
| AR-3826 21 nt Target: | 5'-GATGGCAGAGATCATCTCTGT-3' | (SEQ ID NO: 3466) |
| AR-3827 21 nt Target: | 5'-ATGGCAGAGATCATCTCTGTG-3' | (SEQ ID NO: 3467) |

TABLE 4-continued

DsiRNA Target Sequences (21mers)

| | | | |
|---|---|---|---|
| AR-3828 21 nt Target: | 5'-TGGCAGAGATCATCTCTGTGC-3' | (SEQ ID NO: 3468) |
| AR-3829 21 nt Target: | 5'-GGCAGAGATCATCTCTGTGCA-3' | (SEQ ID NO: 3469) |
| AR-3830 21 nt Target: | 5'-GCAGAGATCATCTCTGTGCAA-3' | (SEQ ID NO: 3470) |
| AR-3831 21 nt Target: | 5'-CAGAGATCATCTCTGTGCAAG-3' | (SEQ ID NO: 3471) |
| AR-3832 21 nt Target: | 5'-AGAGATCATCTCTGTGCAAGT-3' | (SEQ ID NO: 3472) |
| AR-3833 21 nt Target: | 5'-GAGATCATCTCTGTGCAAGTG-3' | (SEQ ID NO: 3473) |
| AR-3834 21 nt Target: | 5'-AGATCATCTCTGTGCAAGTGC-3' | (SEQ ID NO: 3474) |
| AR-3835 21 nt Target: | 5'-GATCATCTCTGTGCAAGTGCC-3' | (SEQ ID NO: 3475) |
| AR-3836 21 nt Target: | 5'-ATCATCTCTGTGCAAGTGCCC-3' | (SEQ ID NO: 3476) |
| AR-3837 21 nt Target: | 5'-TCATCTCTGTGCAAGTGCCCA-3' | (SEQ ID NO: 3477) |
| AR-3838 21 nt Target: | 5'-CATCTCTGTGCAAGTGCCCAA-3' | (SEQ ID NO: 3478) |
| AR-3839 21 nt Target: | 5'-ATCTCTGTGCAAGTGCCCAAG-3' | (SEQ ID NO: 3479) |
| AR-3840 21 nt Target: | 5'-TCTCTGTGCAAGTGCCCAAGA-3' | (SEQ ID NO: 3480) |
| AR-3841 21 nt Target: | 5'-CTCTGTGCAAGTGCCCAAGAT-3' | (SEQ ID NO: 3481) |
| AR-3842 21 nt Target: | 5'-TCTGTGCAAGTGCCCAAGATC-3' | (SEQ ID NO: 3482) |
| AR-3843 21 nt Target: | 5'-CTGTGCAAGTGCCCAAGATCC-3' | (SEQ ID NO: 3483) |
| AR-3844 21 nt Target: | 5'-TGTGCAAGTGCCCAAGATCCT-3' | (SEQ ID NO: 3484) |
| AR-3845 21 nt Target: | 5'-GTGCAAGTGCCCAAGATCCTT-3' | (SEQ ID NO: 3485) |
| AR-3846 21 nt Target: | 5'-TGCAAGTGCCCAAGATCCTTT-3' | (SEQ ID NO: 3486) |
| AR-3847 21 nt Target: | 5'-GCAAGTGCCCAAGATCCTTTC-3' | (SEQ ID NO: 3487) |
| AR-3848 21 nt Target: | 5'-CAAGTGCCCAAGATCCTTTCT-3' | (SEQ ID NO: 3488) |
| AR-3849 21 nt Target: | 5'-AAGTGCCCAAGATCCTTTCTG-3' | (SEQ ID NO: 3489) |
| AR-3850 21 nt Target: | 5'-AGTGCCCAAGATCCTTTCTGG-3' | (SEQ ID NO: 3490) |
| AR-3851 21 nt Target: | 5'-GTGCCCAAGATCCTTTCTGGG-3' | (SEQ ID NO: 3491) |
| AR-3852 21 nt Target: | 5'-TGCCCAAGATCCTTTCTGGGA-3' | (SEQ ID NO: 3492) |
| AR-3853 21 nt Target: | 5'-GCCCAAGATCCTTTCTGGGAA-3' | (SEQ ID NO: 3493) |
| AR-3854 21 nt Target: | 5'-CCCAAGATCCTTTCTGGGAAA-3' | (SEQ ID NO: 3494) |
| AR-3855 21 nt Target: | 5'-CCAAGATCCTTTCTGGGAAAG-3' | (SEQ ID NO: 3495) |
| AR-3856 21 nt Target: | 5'-CAAGATCCTTTCTGGGAAAGT-3' | (SEQ ID NO: 3496) |
| AR-3857 21 nt Target: | 5'-AAGATCCTTTCTGGGAAAGTC-3' | (SEQ ID NO: 3497) |
| AR-3858 21 nt Target: | 5'-AGATCCTTTCTGGGAAAGTCA-3' | (SEQ ID NO: 3498) |
| AR-3859 21 nt Target: | 5'-GATCCTTTCTGGGAAAGTCAA-3' | (SEQ ID NO: 3499) |
| AR-3860 21 nt Target: | 5'-ATCCTTTCTGGGAAAGTCAAG-3' | (SEQ ID NO: 3500) |
| AR-3861 21 nt Target: | 5'-TCCTTTCTGGGAAAGTCAAGC-3' | (SEQ ID NO: 3501) |
| AR-3862 21 nt Target: | 5'-CCTTTCTGGGAAAGTCAAGCC-3' | (SEQ ID NO: 3502) |
| AR-3863 21 nt Target: | 5'-CTTTCTGGGAAAGTCAAGCCC-3' | (SEQ ID NO: 3503) |
| AR-3864 21 nt Target: | 5'-TTTCTGGGAAAGTCAAGCCCA-3' | (SEQ ID NO: 3504) |
| AR-3865 21 nt Target: | 5'-TTCTGGGAAAGTCAAGCCCAT-3' | (SEQ ID NO: 3505) |
| AR-3866 21 nt Target: | 5'-TCTGGGAAAGTCAAGCCCATC-3' | (SEQ ID NO: 3506) |

TABLE 4-continued

DsiRNA Target Sequences (21mers)

| | | |
|---|---|---|
| AR-3867 21 nt Target: | 5'-CTGGGAAAGTCAAGCCCATCT-3' | (SEQ ID NO: 3507) |
| AR-3868 21 nt Target: | 5'-TGGGAAAGTCAAGCCCATCTA-3' | (SEQ ID NO: 3508) |
| AR-3869 21 nt Target: | 5'-GGGAAAGTCAAGCCCATCTAT-3' | (SEQ ID NO: 3509) |
| AR-3870 21 nt Target: | 5'-GGAAAGTCAAGCCCATCTATT-3' | (SEQ ID NO: 3510) |
| AR-3871 21 nt Target: | 5'-GAAAGTCAAGCCCATCTATTT-3' | (SEQ ID NO: 3511) |
| AR-3947 21 nt Target: | 5'-TTCAGATGTCTTCTGCCTGTT-3' | (SEQ ID NO: 3512) |
| AR-3948 21 nt Target: | 5'-TCAGATGTCTTCTGCCTGTTA-3' | (SEQ ID NO: 3513) |
| AR-3949 21 nt Target: | 5'-CAGATGTCTTCTGCCTGTTAT-3' | (SEQ ID NO: 3514) |
| AR-3950 21 nt Target: | 5'-AGATGTCTTCTGCCTGTTATA-3' | (SEQ ID NO: 3515) |
| AR-3999 21 nt Target: | 5'-GGGGAATTTCCTCTATTGATG-3' | (SEQ ID NO: 3516) |
| AR-4054 21 nt Target: | 5'-TTGCTGGGCTTTTTTTTCTC-3' | (SEQ ID NO: 3517) |
| AR-4055 21 nt Target: | 5'-TGCTGGGCTTTTTTTTCTCT-3' | (SEQ ID NO: 3518) |
| AR-4061 21 nt Target: | 5'-GCTTTTTTTTCTCTTTCTCT-3' | (SEQ ID NO: 3519) |
| AR-4066 21 nt Target: | 5'-TTTTTTCTCTTTCTCTCCTTT-3' | (SEQ ID NO: 3520) |
| AR-4086 21 nt Target: | 5'-TCTTTTTCTTCTTCCCTCCCT-3' | (SEQ ID NO: 3521) |
| AR-4174 21 nt Target: | 5'-TGTTGTATGCCTTTAAATCTG-3' | (SEQ ID NO: 3522) |
| AR-4225 21 nt Target: | 5'-TGTGCTTGTTTACAGCACTAC-3' | (SEQ ID NO: 3523) |
| AR-4293 21 nt Target: | 5'-TTAGAGAGCTAAGATTATCTG-3' | (SEQ ID NO: 3524) |
| AR-4313 21 nt Target: | 5'-GGGGAAATCAAAACAAAAACA-3' | (SEQ ID NO: 3525) |
| AR-m258 21 nt Target: | 5'-GGCAGCAGCACACTGAGGATG-3' | (SEQ ID NO: 3718) |
| AR-m361 21 nt Target: | 5'-CTCCGAGGGCCACCCTGAGAG-3' | (SEQ ID NO: 3719) |
| AR-m367 21 nt Target: | 5'-GGGCCACCCTGAGAGCAGCTG-3' | (SEQ ID NO: 3720) |
| AR-m426 21 nt Target: | 5'-GGCTGCCGCAGCAGCCACCAG-3' | (SEQ ID NO: 3721) |
| AR-m502 21 nt Target: | 5'-CACTTTCCCAGGCTTAAGCAG-3' | (SEQ ID NO: 3722) |
| AR-m566 21 nt Target: | 5'-ATGCAACTTCTTCAGCAGCAG-3' | (SEQ ID NO: 3723) |
| AR-m872 21 nt Target: | 5'-GTGCGTCCCACTCCTTGTGCG-3' | (SEQ ID NO: 3724) |
| AR-m1020 21 nt Target: | 5'-CTGGCAGCAGTGAAGCAGGTA-3' | (SEQ ID NO: 3725) |
| AR-m1136 21 nt Target: | 5'-TTTCCGCTGGCTCTGTCCGGG-3' | (SEQ ID NO: 3726) |
| AR-m1224 21 nt Target: | 5'-GCAGCGCCTGGGCTGCGGCGG-3' | (SEQ ID NO: 3727) |
| AR-m1229 21 nt Target: | 5'-GCCTGGGCTGCGGCGGCAGCG-3' | (SEQ ID NO: 3728) |
| AR-m1236 21 nt Target: | 5'-CTGCGGCGGCAGCGCAATGCC-3' | (SEQ ID NO: 3729) |
| AR-m1291 21 nt Target: | 5'-TGTAGCCGGGCCCAGCACTGG-3' | (SEQ ID NO: 3730) |
| AR-m1335 21 nt Target: | 5'-CTTCCTGGCATACTCTCTTCA-3' | (SEQ ID NO: 3731) |
| AR-m1403 21 nt Target: | 5'-AGCAGCCCAAGCGATGCCGGG-3' | (SEQ ID NO: 3732) |
| AR-m1694 21 nt Target: | 5'-GCTTCTGGCTGTCACTACGGA-3' | (SEQ ID NO: 3733) |
| AR-m1711 21 nt Target: | 5'-CGGAGCTCTCACTTGTGGCAG-3' | (SEQ ID NO: 3734) |
| AR-m1720 21 nt Target: | 5'-CACTTGTGGCAGCTGCAAGGT-3' | (SEQ ID NO: 3735) |
| AR-m1725 21 nt Target: | 5'-GTGGCAGCTGCAAGGTCTTCT-3' | (SEQ ID NO: 3736) |
| AR-m1865 21 nt Target: | 5'-GGGATGACTCTGGGAGCTCGT-3' | (SEQ ID NO: 3737) |

TABLE 4-continued

DsiRNA Target Sequences (21mers)

| | | |
|---|---|---|
| AR-m1874 21 nt Target: | 5'-CTGGGAGCTCGTAAGCTGAAG-3' | (SEQ ID NO: 3738) |
| AR-m2079 21 nt Target: | 5'-CAGATTCCTTTGCTGCCTTGT-3' | (SEQ ID NO: 3739) |
| AR-m2086 21 nt Target: | 5'-CTTTGCTGCCTTGTTATCTAG-3' | (SEQ ID NO: 3740) |
| AR-m2162 21 nt Target: | 5'-TTGCCTGGCTTCCGCAACTTG-3' | (SEQ ID NO: 3741) |
| AR-m2219 21 nt Target: | 5'-TGGATGGGACTGATGGTATTT-3' | (SEQ ID NO: 3742) |
| AR-m2275 21 nt Target: | 5'-CAGGATGCTCTACTTTGCACC-3' | (SEQ ID NO: 3743) |
| AR-m2280 21 nt Target: | 5'-TGCTCTACTTTGCACCTGACT-3' | (SEQ ID NO: 3744) |
| AR-m2287 21 nt Target: | 5'-CTTTGCACCTGACTTGGTTTT-3' | (SEQ ID NO: 3745) |
| AR-m2297 21 nt Target: | 5'-GACTTGGTTTTCAATGAGTAC-3' | (SEQ ID NO: 3746) |
| AR-m2312 21 nt Target: | 5'-GAGTACCGCATGCACAAGTCT-3' | (SEQ ID NO: 3747) |
| AR-m2411 21 nt Target: | 5'-CTGTGCATGAAAGCACTGCTG-3' | (SEQ ID NO: 3748) |
| AR-m2416 21 nt Target: | 5'-CATGAAAGCACTGCTGCTCTT-3' | (SEQ ID NO: 3749) |
| AR-m2422 21 nt Target: | 5'-AGCACTGCTGCTCTTCAGCAT-3' | (SEQ ID NO: 3750) |
| AR-m2427 21 nt Target: | 5'-TGCTGCTCTTCAGCATTATTC-3' | (SEQ ID NO: 3751) |
| AR-m2571 21 nt Target: | 5'-AGCTCACCAAGCTCCTGGATT-3' | (SEQ ID NO: 3752) |
| AR-m2580 21 nt Target: | 5'-AGCTCCTGGATTCTGTGCAGC-3' | (SEQ ID NO: 3753) |
| AR-m2585 21 nt Target: | 5'-CTGGATTCTGTGCAGCCTATT-3' | (SEQ ID NO: 3754) |
| AR-m2591 21 nt Target: | 5'-TCTGTGCAGCCTATTGCAAGA-3' | (SEQ ID NO: 3755) |
| AR-m2597 21 nt Target: | 5'-CAGCCTATTGCAAGAGAGCTG-3' | (SEQ ID NO: 3756) |
| AR-m2661 21 nt Target: | 5'-GCGTGGACTTTCCTGAAATGA-3' | (SEQ ID NO: 3757) |
| AR-m2809 21 nt Target: | 5'-TCTTCTGCCTGTTATATAACT-3' | (SEQ ID NO: 3758) |
| AR-m2831 21 nt Target: | 5'-TGCACTACTTCTCTGCAGTGC-3' | (SEQ ID NO: 3759) |
| AR-m2912 21 nt Target: | 5'-TCCTGGGCTTCTCCTTCTTTT-3' | (SEQ ID NO: 3760) |
| AR-m2918 21 nt Target: | 5'-GCTTCTCCTTCTTTTTTTTTC-3' | (SEQ ID NO: 3761) |
| AR-m2926 21 nt Target: | 5'-TTCTTTTTTTTCTTCTTCCC-3' | (SEQ ID NO: 3762) |
| AR-m2981 21 nt Target: | 5'-CTGCTGCGTATTGTGGCTCCT-3' | (SEQ ID NO: 3763) |
| AR-m2992 21 nt Target: | 5'-TGTGGCTCCTGCCTTTGTTTT-3' | (SEQ ID NO: 3764) |
| AR-m2997 21 nt Target: | 5'-CTCCTGCCTTTGTTTGATTT-3' | (SEQ ID NO: 3765) |

Within Tables 2 and 3 above and Tables 5-12 below, underlined residues indicate 2'-O-methyl residues, UPPER CASE indicates ribonucleotides, and lower case denotes deoxyribonucleotides. The DsiRNA agents of Tables 2-3 above and 9-12 below are 25/27 mer agents possessing a blunt end. The structures and/or modification patterning of the agents of Tables 2-3 above and 9-12 below can be readily adapted to the above generic sequence structures, e.g., the 3' overhang of the second strand can be extended or contracted, 2'-O-methylation of the second strand can be expanded towards the 5' end of the second strand, optionally at alternating sites, etc. Such further modifications are optional, as 25/27mer DsiRNAs with such modifications can also be readily designed from the above DsiRNA agents and are also expected to be functional inhibitors of AR expression. Similarly, the 27mer "blunt/fray" and "blunt/blunt" DsiRNA structures and/or modification patterns of the agents of Tables 5-8 below can also be readily adapted to the above generic sequence structures, e.g., for application of modification patterning of the antisense strand to such structures and/or adaptation of such sequences to the above generic structures.

In certain embodiments, 27mer DsiRNAs possessing independent strand lengths each of 27 nucleotides are designed and synthesized for targeting of the same sites within the AR transcript as the asymmetric "25/27" structures shown in Tables 2-3 and 9-12 herein. Exemplary "27/27" DsiRNAs are optionally designed with a "blunt/fray" structure as shown for the DsiRNAs of Tables 5 and 6 below, or with a "blunt/blunt" structure as shown for the DsiRNAs of Tables 7 and 8 below.

TABLE 5

Selected Human Anti-AR 27mer "Blunt/Fray" DsiRNA Agents

5'-UGAAGUUUUUAAAAGCUGCUAAAGA$^{AC-3'}$ (SEQ ID NO: 3784)
3'-ACUUCAAAAAUUUUCGACGAUUUCU$_{GA-5'}$ (SEQ ID NO: 154)

AR-252 Target: 5'-TGAAGTTTTTAAAAGCTGCTAAAGACT-3' (SEQ ID NO: 307)

5'-GAAGUUUUUAAAAGCUGCUAAAGAC$^{CA-3'}$ (SEQ ID NO: 3785)
3'-CUUCAAAAAUUUUCGACGAUUUCUG$_{AG-5'}$ (SEQ ID NO: 155)

AR-253 Target: 5'-GAAGTTTTTAAAAGCTGCTAAAGACTC-3' (SEQ ID NO: 308)

5'-AAGUUUUUAAAAGCUGCUAAAGACU$^{AA-3'}$ (SEQ ID NO: 3786)
3'-UUCAAAAAUUUUCGACGAUUUCUGA$_{GC-5'}$ (SEQ ID NO: 156)

AR-254 Target: 5'-AAGTTTTTAAAAGCTGCTAAAGACTCG-3' (SEQ ID NO: 309)

5'-UGCGGAGCCAGAGAUCAAAAGAUGA$^{CC-3'}$ (SEQ ID NO: 3787)
3'-ACGCCUCGGUCUCUAGUUUUCUACU$_{UU-5'}$ (SEQ ID NO: 157)

AR-682 Target: 5'-TGCGGAGCCAGAGATCAAAAGATGAAA-3' (SEQ ID NO: 310)

5'-GCCAGAGAUCAAAAGAUGAAAAGGC$^{CA-3'}$ (SEQ ID NO: 3788)
3'-CGGUCUCUAGUUUUCUACUUUUCCG$_{UC-5'}$ (SEQ ID NO: 158)

AR-688 Target: 5'-GCCAGAGATCAAAAGATGAAAAGGCAG-3' (SEQ ID NO: 311)

5'-CCAGAGAUCAAAAGAUGAAAAGGCA$^{AC-3'}$ (SEQ ID NO: 3789)
3'-GGUCUCUAGUUUUCUACUUUUCCGU$_{CA-5'}$ (SEQ ID NO: 159)

AR-689 Target: 5'-CCAGAGATCAAAAGATGAAAAGGCAGT-3' (SEQ ID NO: 312)

5'-CAAAAGAUGAAAAGGCAGUCAGGUC$^{CC-3'}$ (SEQ ID NO: 3790)
3'-GUUUUCUACUUUUCCGUCAGUCCAG$_{AA-5'}$ (SEQ ID NO: 160)

AR-697 Target: 5'-CAAAAGATGAAAAGGCAGTCAGGTCTT-3' (SEQ ID NO: 313)

5'-AAAAGAUGAAAAGGCAGUCAGGUCU$^{CA-3'}$ (SEQ ID NO: 3791)
3'-UUUUCUACUUUUCCGUCAGUCCAGA$_{AG-5'}$ (SEQ ID NO: 161)

AR-698 Target: 5'-AAAAGATGAAAAGGCAGTCAGGTCTTC-3' (SEQ ID NO: 314)

5'-GUCAGGUCUUCAGUAGCCAAAAAAC$^{CC-3'}$ (SEQ ID NO: 3792)
3'-CAGUCCAGAAGUCAUCGGUUUUUUG$_{UU-5'}$ (SEQ ID NO: 162)

AR-714 Target: 5'-GTCAGGTCTTCAGTAGCCAAAAACAA-3' (SEQ ID NO: 315)

5'-UCAGGUCUUCAGUAGCCAAAAACA$^{CC-3'}$ (SEQ ID NO: 3793)
3'-AGUCCAGAAGUCAUCGGUUUUUUGU$_{UU-5'}$ (SEQ ID NO: 163)

AR-715 Target: 5'-TCAGGTCTTCAGTAGCCAAAAACAAA-3' (SEQ ID NO: 316)

5'-CAGUAGCCAAAAAACAAAACAAACA$^{CC-3'}$ (SEQ ID NO: 3794)
3'-GUCAUCGGUUUUUUGUUUUGUUUGU$_{UU-5'}$ (SEQ ID NO: 164)

AR-724 Target: 5'-CAGTAGCCAAAAACAAAACAAACAAA-3' (SEQ ID NO: 317)

TABLE 5-continued

Selected Human Anti-AR 27mer "Blunt/Fray" DsiRNA Agents

5'-GCCAAAAAACAAAACAAACAAAAAC$^{CC-3'}$ (SEQ ID NO: 3795)
3'-CGGUUUUUUGUUUUGUUUGUUUUUG$_{U-5'}$ (SEQ ID NO: 165)

AR-729 Target: 5'-GCCAAAAAACAAAACAAACAAAAACAA-3' (SEQ ID NO: 318)

5'-CCAAAAAACAAAACAAACAAAAACA$^{CC-3'}$ (SEQ ID NO: 3796)
3'-GGUUUUUUGUUUUGUUUGUUUUUGU$_{U-5'}$ (SEQ ID NO: 166)

AR-730 Target: 5'-CCAAAAAACAAAACAAACAAAAACAAA-3' (SEQ ID NO: 319)

5'-ACAAACAAACAAAAACAAAAAGC$^{AA-3'}$ (SEQ ID NO: 3797)
3'-UGUUUGUUUGUUUUUGUUUUUCG$_{G-C-5'}$ (SEQ ID NO: 167)

AR-737 Target: 5'-ACAAACAAACAAAAACAAAAAGCCG-3' (SEQ ID NO: 320)

5'-AACAAAAACAAAAAGCCGAAAUAA$^{CC-3'}$ (SEQ ID NO: 3798)
3'-UUGUUUUUGUUUUUCGGCUUUAUU$_{U-5'}$ (SEQ ID NO: 168)

AR-745 Target: 5'-AACAAAAACAAAAAGCCGAAATAAAA-3' (SEQ ID NO: 321)

5'-ACAAAAACAAAAAGCCGAAAUAAA$^{CA-3'}$ (SEQ ID NO: 3799)
3'-UGUUUUUGUUUUUCGGCUUUAUUU$_{C-5'}$ (SEQ ID NO: 169)

AR-746 Target: 5'-ACAAAAACAAAAAGCCGAAATAAAAG-3' (SEQ ID NO: 322)

5'-CAAAAACAAAAAGCCGAAAUAAAA$^{AC-3'}$ (SEQ ID NO: 3800)
3'-GUUUUUGUUUUUCGGCUUUAUUUU$_{C-U-5'}$ (SEQ ID NO: 170)

AR-747 Target: 5'-CAAAAACAAAAAGCCGAAATAAAAGA-3' (SEQ ID NO: 323)

5'-ACAAAAAGCCGAAAUAAAAGAAAA$^{CA-3'}$ (SEQ ID NO: 3801)
3'-UGUUUUUUCGGCUUUAUUUUCUUUU$_{C-5'}$ (SEQ ID NO: 171)

AR-752 Target: 5'-ACAAAAAGCCGAAATAAAAGAAAAG-3' (SEQ ID NO: 324)

5'-CAAAAAAGCCGAAAUAAAAGAAAAA$^{AC-3'}$ (SEQ ID NO: 3802)
3'-GUUUUUUCGGCUUUAUUUUCUUUUU$_{C-U-5'}$ (SEQ ID NO: 172)

AR-753 Target: 5'-CAAAAAAGCCGAAATAAAAGAAAAGA-3' (SEQ ID NO: 325)

5'-AAAAAGCCGAAAUAAAAGAAAAGA$^{CC-3'}$ (SEQ ID NO: 3803)
3'-UUUUUCGGCUUUAUUUUCUUUUCU$_{A-U-5'}$ (SEQ ID NO: 173)

AR-755 Target: 5'-AAAAAGCCGAAATAAAAGAAAAGATA-3' (SEQ ID NO: 326)

5'-GCCGAAAUAAAAGAAAAGAUAAUA$^{CA-3'}$ (SEQ ID NO: 3804)
3'-CGGCUUUAUUUUCUUUUCUAUUAU$_{G-5'}$ (SEQ ID NO: 174)

AR-760 Target: 5'-GCCGAAATAAAAGAAAAGATAATAAC-3' (SEQ ID NO: 327)

5'-CCGAAAUAAAAGAAAAGAUAAUAA$^{AC-3'}$ (SEQ ID NO: 3805)
3'-GGCUUUAUUUUCUUUUCUAUUAUU$_{G-A-5'}$ (SEQ ID NO: 175)

AR-761 Target: 5'-CCGAAATAAAAGAAAAGATAATAACT-3' (SEQ ID NO: 328)

5'-CGAAAUAAAAGAAAAGAUAAUAAC$^{CA-3'}$ (SEQ ID NO: 3806)
3'-GCUUUAUUUUCUUUUCUAUUAUUG$_{A-G-5'}$ (SEQ ID NO: 176)

AR-762 Target: 5'-CGAAATAAAAGAAAAGATAATAACTC-3' (SEQ ID NO: 329)

TABLE 5-continued

Selected Human Anti-AR 27mer "Blunt/Fray" DsiRNA Agents

5'-AAGAAAAAGAUAAUAACUCAGUUCU$^{CC-3'}$ (SEQ ID NO: 3807)
3'-UUCUUUUUCUAUUAUUGAGUCAAGA$_{AU-5'}$ (SEQ ID NO: 177)

AR-770 Target: 5'-AAGAAAAAGATAATAACTCAGTTCTTA-3' (SEQ ID NO: 330)

5'-AAAAGAUAAUAACUCAGUUCUUAUU$^{CA-3'}$ (SEQ ID NO: 3808)
3'-UUUUCUAUUAUUGAGUCAAGAAUAA$_{AC-5'}$ (SEQ ID NO: 178)

AR-774 Target: 5'-AAAAGATAATAACTCAGTTCTTATTTG-3' (SEQ ID NO: 331)

5'-AAAGAUAAUAACUCAGUUCUUAUUU$^{AA-3'}$ (SEQ ID NO: 3809)
3'-UUUCUAUUAUUGAGUCAAGAAUAAA$_{CG-5'}$ (SEQ ID NO: 179)

AR-775 Target: 5'-AAAGATAATAACTCAGTTCTTATTTGC-3' (SEQ ID NO: 332)

5'-AGAUAAUAACUCAGUUCUUAUUUGC$^{CA-3'}$ (SEQ ID NO: 3810)
3'-UCUAUUAUUGAGUCAAGAAUAAACG$_{UG-5'}$ (SEQ ID NO: 180)

AR-777 Target: 5'-AGATAATAACTCAGTTCTTATTTGCAC-3' (SEQ ID NO: 333)

5'-GAUAAUAACUCAGUUCUUAUUUGCA$^{AA-3'}$ (SEQ ID NO: 3811)
3'-CUAUUAUUGAGUCAAGAAUAAACGU$_{GG-5'}$ (SEQ ID NO: 181)

AR-778 Target: 5'-GATAATAACTCAGTTCTTATTTGCACC-3' (SEQ ID NO: 334)

5'-UCUUAUUUGCACCUACUUCAGUGGA$^{AC-3'}$ (SEQ ID NO: 3812)
3'-AGAAUAAACGUGGAUGAAGUCACCU$_{GU-5'}$ (SEQ ID NO: 182)

AR-792 Target: 5'-TCTTATTTGCACCTACTTCAGTGGACA-3' (SEQ ID NO: 335)

5'-UCAGUGGACACUGAAUUUGGAAGGU$^{AA-3'}$ (SEQ ID NO: 3813)
3'-AGUCACCUGUGACUUAAACCUUCCA$_{CC-5'}$ (SEQ ID NO: 183)

AR-809 Target: 5'-TCAGTGGACACTGAATTTGGAAGGTGG-3' (SEQ ID NO: 336)

5'-CACUGAAUUUGGAAGGUGGAGGAUU$^{CC-3'}$ (SEQ ID NO: 3814)
3'-GUGACUUAAACCUUCCACCUCCUAA$_{AA-5'}$ (SEQ ID NO: 184)

AR-817 Target: 5'-CACTGAATTTGGAAGGTGGAGGATTTT-3' (SEQ ID NO: 337)

5'-UUUGGAAGGUGGAGGAUUUUGUUUU$^{CC-3'}$ (SEQ ID NO: 3815)
3'-AAACCUUCCACCUCCUAAAACAAAA$_{AA-5'}$ (SEQ ID NO: 185)

AR-824 Target: 5'-TTTGGAAGGTGGAGGATTTTGTTTTTT-3' (SEQ ID NO: 338)

5'-GGAAGGUGGAGGAUUUUGUUUUUUU$^{AC-3'}$ (SEQ ID NO: 3816)
3'-CCUUCCACCUCCUAAAACAAAAAAA$_{GA-5'}$ (SEQ ID NO: 186)

AR-827 Target: 5'-GGAAGGTGGAGGATTTTGTTTTTTCT-3' (SEQ ID NO: 339)

5'-UGGAGGAUUUUGUUUUUUCUUUUA$^{CA-3'}$ (SEQ ID NO: 3817)
3'-ACCUCCUAAAACAAAAAAGAAAAU$_{UC-5'}$ (SEQ ID NO: 187)

AR-833 Target: 5'-TGGAGGATTTTGTTTTTTCTTTTAAG-3' (SEQ ID NO: 340)

5'-GGAGGAUUUUGUUUUUUCUUUUAA$^{AC-3'}$ (SEQ ID NO: 3818)
3'-CCUCCUAAAACAAAAAAGAAAAUU$_{CU-5'}$ (SEQ ID NO: 188)

AR-834 Target: 5'-GGAGGATTTTGTTTTTTCTTTTAAGA-3' (SEQ ID NO: 341)

TABLE 5-continued

Selected Human Anti-AR 27mer "Blunt/Fray" DsiRNA Agents

5'-AGGAUUUGUUUUUUCUUUUAAGA$^{cA-3'}$ (SEQ ID NO: 3819)
3'-UCCUAAAACAAAAAAGAAAAUUCU$_{AG-5'}$ (SEQ ID NO: 189)

AR-836 Target: 5'-AGGATTTTGTTTTTTCTTTTAAGATC-3' (SEQ ID NO: 342)

5'-GGAUUUUGUUUUUUCUUUUAAGAU$^{AC-3'}$ (SEQ ID NO: 3820)
3'-CCUAAAACAAAAAAGAAAAUUCUA$_{A-5'}$ (SEQ ID NO: 190)

AR-837 Target: 5'-GGATTTTGTTTTTTCTTTTAAGATCT-3' (SEQ ID NO: 343)

5'-GAUUUUGUUUUUUCUUUUAAGAUC$^{CA-3'}$ (SEQ ID NO: 3821)
3'-CUAAAACAAAAAAGAAAAUUCUAG$_{AC-5'}$ (SEQ ID NO: 191)

AR-838 Target: 5'-GATTTTGTTTTTTCTTTTAAGATCTG-3' (SEQ ID NO: 344)

5'-AUUUUGUUUUUUCUUUUAAGAUCU$^{AA-3'}$ (SEQ ID NO: 3822)
3'-UAAAACAAAAAAGAAAAUUCUAGA$_{CC-5'}$ (SEQ ID NO: 192)

AR-839 Target: 5'-ATTTTGTTTTTTCTTTTAAGATCTGG-3' (SEQ ID NO: 345)

5'-UGUUUUUUCUUUUAAGAUCUGGGC$^{CC-3'}$ (SEQ ID NO: 3823)
3'-ACAAAAAAGAAAAUUCUAGACCCG$_{UA-5'}$ (SEQ ID NO: 193)

AR-843 Target: 5'-TGTTTTTTCTTTTAAGATCTGGGCAT-3' (SEQ ID NO: 346)

5'-GUUUUUUCUUUUAAGAUCUGGGCA$^{cA-3'}$ (SEQ ID NO: 3824)
3'-CAAAAAAGAAAAUUCUAGACCCGU$_{AG-5'}$ (SEQ ID NO: 194)

AR-844 Target: 5'-GTTTTTTCTTTTAAGATCTGGGCATC-3' (SEQ ID NO: 347)

5'-UUUAAGAUCUGGGCAUCUUUUGAAU$^{AC-3'}$ (SEQ ID NO: 3825)
3'-AAAUUCUAGACCCGUAGAAAACUUA$_{GA-5'}$ (SEQ ID NO: 195)

AR-854 Target: 5'-TTTAAGATCTGGGCATCTTTTGAATCT-3' (SEQ ID NO: 348)

5'-AUCUUUUGAAUCUACCCUUCAAGUA$^{CC-3'}$ (SEQ ID NO: 3826)
3'-UAGAAAACUUAGAUGGGAAGUUCAU$_{AA-5'}$ (SEQ ID NO: 196)

AR-868 Target: 5'-ATCTTTTGAATCTACCCTTCAAGTATT-3' (SEQ ID NO: 349)

5'-UCUUUUGAAUCUACCCUUCAAGUAU$^{CC-3'}$ (SEQ ID NO: 3827)
3'-AGAAAACUUAGAUGGGAAGUUCAUA$_{AU-5'}$ (SEQ ID NO: 197)

AR-869 Target: 5'-TCTTTTGAATCTACCCTTCAAGTATTA-3' (SEQ ID NO: 350)

5'-CUUUUGAAUCUACCCUUCAAGUAUU$^{CC-3'}$ (SEQ ID NO: 3828)
3'-GAAAACUUAGAUGGGAAGUUCAUAA$_{UU-5'}$ (SEQ ID NO: 198)

AR-870 Target: 5'-CTTTTGAATCTACCCTTCAAGTATTAA-3' (SEQ ID NO: 351)

5'-UUUUGAAUCUACCCUUCAAGUAUUA$^{cA-3'}$ (SEQ ID NO: 3829)
3'-AAAACUUAGAUGGGAAGUUCAUAAU$_{UC-5'}$ (SEQ ID NO: 199)

AR-871 Target: 5'-TTTTGAATCTACCCTTCAAGTATTAAG-3' (SEQ ID NO: 352)

5'-UUUGAAUCUACCCUUCAAGUAUUAA$^{AC-3'}$ (SEQ ID NO: 3830)
3'-AAACUUAGAUGGGAAGUUCAUAAUU$_{CU-5'}$ (SEQ ID NO: 200)

AR-872 Target: 5'-TTTGAATCTACCCTTCAAGTATTAAGA-3' (SEQ ID NO: 353)

TABLE 5-continued

Selected Human Anti-AR 27mer "Blunt/Fray" DsiRNA Agents

5'-UCAAGUAUUAAGAGACAGACUGUGA$^{AA\text{-}3'}$ (SEQ ID NO: 3831)
3'-AGUUCAUAAUUCUCUGUCUGACACU$_{G\text{-}5'}^{C}$ (SEQ ID NO: 201)

AR-886 Target: 5'-TCAAGTATTAAGAGACAGACTGTGAGC-3' (SEQ ID NO: 354)

5'-AGUAUUAAGAGACAGACUGUGAGCC$^{CC\text{-}3'}$ (SEQ ID NO: 3832)
3'-UCAUAAUUCUCUGUCUGACACUCGG$_{U\text{-}5'}^{A}$ (SEQ ID NO: 202)

AR-889 Target: 5'-AGTATTAAGAGACAGACTGTGAGCCTA-3' (SEQ ID NO: 355)

5'-CUGUUGAACUCUUCUGAGCAAGAGA$^{CA\text{-}3'}$ (SEQ ID NO: 3833)
3'-GACAACUUGAGAAGACUCGUUCUCU$_{C\text{-}5'}^{U}$ (SEQ ID NO: 203)

AR-1067 Target: 5'-CTGTTGAACTCTTCTGAGCAAGAGAAG-3' (SEQ ID NO: 356)

5'-UGUUGAACUCUUCUGAGCAAGAGAA$^{AA\text{-}3'}$ (SEQ ID NO: 3834)
3'-ACAACUUGAGAAGACUCGUUCUCUU$_{C\text{-}5'}^{U}$ (SEQ ID NO: 204)

AR-1068 Target: 5'-TGTTGAACTCTTCTGAGCAAGAGAAGG-3' (SEQ ID NO: 357)

5'-CAAGGAUGGAAGUGCAGUUAGGGCU$^{AA\text{-}3'}$ (SEQ ID NO: 3835)
3'-GUUCCUACCUUCACGUCAAUCCCGA$_{C\text{-}5'}^{C}$ (SEQ ID NO: 205)

AR-1137 Target: 5'-CAAGGATGGAAGTGCAGTTAGGGCTGG-3' (SEQ ID NO: 358)

5'-CCGAGGAGCUUUCCAGAAUCUGUUC$^{AC\text{-}3'}$ (SEQ ID NO: 3836)
3'-GGCUCCUCGAAAGGUCUUAGACAAG$_{U\text{-}5'}^{G}$ (SEQ ID NO: 206)

AR-1198 Target: 5'-CCGAGGAGCTTTCCAGAATCTGTTCCA-3' (SEQ ID NO: 359)

5'-CGAGGAGCUUUCCAGAAUCUGUUCC$^{CA\text{-}3'}$ (SEQ ID NO: 3837)
3'-GCUCCUCGAAAGGUCUUAGACAAGG$_{C\text{-}5'}^{U}$ (SEQ ID NO: 207)

AR-1199 Target: 5'-CGAGGAGCTTTCCAGAATCTGTTCCAG-3' (SEQ ID NO: 360)

5'-CGCUGACCUUAAAGACAUCCUGAGC$^{AC\text{-}3'}$ (SEQ ID NO: 3838)
3'-GCGACUGGAAUUUCUGUAGGACUCG$_{U\text{-}5'}^{C}$ (SEQ ID NO: 208)

AR-1675 Target: 5'-CGCTGACCTTAAAGACATCCTGAGCGA-3' (SEQ ID NO: 361)

5'-UCCAAGGACAAUUACUUAGGGGGCA$^{AC\text{-}3'}$ (SEQ ID NO: 3839)
3'-AGGUUCCUGUUAAUGAAUCCCCCGU$_{A\text{-}5'}^{G}$ (SEQ ID NO: 209)

AR-1802 Target: 5'-TCCAAGGACAATTACTTAGGGGGCACT-3' (SEQ ID NO: 362)

5'-CCAAGGAGUUGUGUAAGGCAGUGUC$^{AA\text{-}3'}$ (SEQ ID NO: 3840)
3'-GGUUCCUCAACACAUUCCGUCACAG$_{C\text{-}5'}^{C}$ (SEQ ID NO: 210)

AR-1848 Target: 5'-CCAAGGAGTTGTGTAAGGCAGTGTCGG-3' (SEQ ID NO: 363)

5'-CACUGAAGAUACUGCUGAGUAUUCC$^{AA\text{-}3'}$ (SEQ ID NO: 3841)
3'-GUGACUUCUAUGACGACUCAUAAGG$_{G\text{-}5'}^{A}$ (SEQ ID NO: 211)

AR-2047 Target: 5'-CACTGAAGATACTGCTGAGTATTCCCC-3' (SEQ ID NO: 364)

5'-UGCUGAGUAUUCCCCUUUCAAGGGA$^{AA\text{-}3'}$ (SEQ ID NO: 3842)
3'-ACGACUCAUAAGGGGAAAGUUCCCU$_{C\text{-}5'}^{C}$ (SEQ ID NO: 212)

AR-2059 Target: 5'-TGCTGAGTATTCCCCTTTCAAGGGAGG-3' (SEQ ID NO: 365)

TABLE 5-continued

Selected Human Anti-AR 27mer "Blunt/Fray" DsiRNA Agents

5'-CACUUGUGUCAAAAGCGAAAUGGGC$^{AA-3'}$ (SEQ ID NO: 3843)
3'-GUGAACACAGUUUUCGCUUUACCCG$_{G-5'}^{G}$ (SEQ ID NO: 213)

AR-2692 Target: 5'-CACTTGTGTCAAAAGCGAAATGGGCCC-3' (SEQ ID NO: 366)

5'-ACUUGUGUCAAAAGCGAAAUGGGCC$^{AA-3'}$ (SEQ ID NO: 3844)
3'-UGAACACAGUUUUCGCUUUACCCGG$_{G-5'}^{G}$ (SEQ ID NO: 214)

AR-2693 Target: 5'-ACTTGTGTCAAAAGCGAAATGGGCCCC-3' (SEQ ID NO: 367)

5'-ACCAUGUUUUGCCCAUUGACUAUUA$^{AC-3'}$ (SEQ ID NO: 3845)
3'-UGGUACAAAACGGGUAACUGAUAAU$_{A-5'}^{G}$ (SEQ ID NO: 215)

AR-2775 Target: 5'-ACCATGTTTTGCCCATTGACTATTACT-3' (SEQ ID NO: 368)

5'-CAUGUUUUGCCCAUUGACUAUUACU$^{CC-3'}$ (SEQ ID NO: 3846)
3'-GUACAAAACGGGUAACUGAUAAUGA$_{A-5'}^{A}$ (SEQ ID NO: 216)

AR-2777 Target: 5'-CATGTTTTGCCCATTGACTATTACTTT-3' (SEQ ID NO: 369)

5'-CUGUGGAGAUGAAGCUUCUGGGUGU$^{AC-3'}$ (SEQ ID NO: 3847)
3'-GACACCUCUACUUCGAAGACCCACA$_{U-5'}^{G}$ (SEQ ID NO: 217)

AR-2827 Target: 5'-CTGTGGAGATGAAGCTTCTGGGTGTCA-3' (SEQ ID NO: 370)

5'-UGAAGGGAAACAGAAGUACCUGUGC$^{AA-3'}$ (SEQ ID NO: 3848)
3'-ACUUCCCUUUGUCUUCAUGGACACG$_{G-5'}^{C}$ (SEQ ID NO: 218)

AR-2905 Target: 5'-TGAAGGGAAACAGAAGTACCTGTGCGC-3' (SEQ ID NO: 371)

5'-GCAGAAAUGAUUGCACUAUUGAUAA$^{CC-3'}$ (SEQ ID NO: 3849)
3'-CGUCUUUACUAACGUGAUAACUAUU$_{A-5'}^{U}$ (SEQ ID NO: 219)

AR-2934 Target: 5'-CCAAAAAACAAAACAAACAAAAACAAA-3' (SEQ ID NO: 372)

5'-CAGAAAUGAUUGCACUAUUGAUAAA$^{CC-3'}$ (SEQ ID NO: 3850)
3'-GUCUUUACUAACGUGAUAACUAUUU$_{A-5'}^{A}$ (SEQ ID NO: 220)

AR-2935 Target: 5'-CCAAAAAACAAAACAAACAAAAACAAA-3' (SEQ ID NO: 373)

5'-AGAAAUGAUUGCACUAUUGAUAAAU$^{CA-3'}$ (SEQ ID NO: 3851)
3'-UCUUUACUAACGUGAUAACUAUUUA$_{G-5'}^{A}$ (SEQ ID NO: 221)

AR-2936 Target: 5'-CCAAAAAACAAAACAAACAAAAACAAA-3' (SEQ ID NO: 374)

5'-AAAUGAUUGCACUAUUGAUAAAUUC$^{AA-3'}$ (SEQ ID NO: 3852)
3'-UUUACUAACGUGAUAACUAUUUAAG$_{C-5'}^{G}$ (SEQ ID NO: 222)

AR-2938 Target: 5'-AAATGATTGCACTATTGATAAATTCCG-3' (SEQ ID NO: 375)

5'-AAUGAUUGCACUAUUGAUAAAUUCC$^{AC-3'}$ (SEQ ID NO: 3853)
3'-UUACUAACGUGAUAACUAUUUAAGG$_{U-5'}^{C}$ (SEQ ID NO: 223)

AR-2939 Target: 5'-AATGATTGCACTATTGATAAATTCCGA-3' (SEQ ID NO: 376)

5'-CACUAUUGAUAAAUUCCGAAGGAAA$^{CC-3'}$ (SEQ ID NO: 3854)
3'-GUGAUAACUAUUUAAGGCUUCCUUU$_{U-5'}^{U}$ (SEQ ID NO: 224)

AR-2947 Target: 5'-CACTATTGATAAATTCCGAAGGAAAAA-3' (SEQ ID NO: 377)

TABLE 5-continued

Selected Human Anti-AR 27mer "Blunt/Fray" DsiRNA Agents

5'-ACUAUUGAUAAAUUCCGAAGGAAAA$^{CC-3'}$ (SEQ ID NO: 3855)
3'-UGAUAACUAUUUAAGGCUUCCUUUU$_{UA-5'}$ (SEQ ID NO: 225)

AR-2948 Target: 5'-ACTATTGATAAATTCCGAAGGAAAAAT-3' (SEQ ID NO: 378)

5'-CUAUUGAUAAAUUCCGAAGGAAAAA$^{CC-3'}$ (SEQ ID NO: 3856)
3'-GAUAACUAUUUAAGGCUUCCUUUUU$_{AA-5'}$ (SEQ ID NO: 226)

AR-2949 Target: 5'-CTATTGATAAATTCCGAAGGAAAAATT-3' (SEQ ID NO: 379)

5'-UAUUGAUAAAUUCCGAAGGAAAAAU$^{CA-3'}$ (SEQ ID NO: 3857)
3'-AUAACUAUUUAAGGCUUCCUUUUUA$_{AC-5'}$ (SEQ ID NO: 227)

AR-2950 Target: 5'-TATTGATAAATTCCGAAGGAAAAATTG-3' (SEQ ID NO: 380)

5'-AUUGAUAAAUUCCGAAGGAAAAAUU$^{AC-3'}$ (SEQ ID NO: 3858)
3'-UAACUAUUUAAGGCUUCCUUUUUAA$_{CA-5'}$ (SEQ ID NO: 228)

AR-2951 Target: 5'-ATTGATAAATTCCGAAGGAAAAATTGT-3' (SEQ ID NO: 381)

5'-UGAUAAAUUCCGAAGGAAAAAUUGU$^{AA-3'}$ (SEQ ID NO: 3859)
3'-ACUAUUUAAGGCUUCCUUUUUAACA$_{GG-5'}$ (SEQ ID NO: 229)

AR-2953 Target: 5'-TGATAAATTCCGAAGGAAAAATTGTCC-3' (SEQ ID NO: 382)

5'-GAUAAAUUCCGAAGGAAAAAUUGUC$^{AC-3'}$ (SEQ ID NO: 3860)
3'-CUAUUUAAGGCUUCCUUUUUAACAG$_{GU-5'}$ (SEQ ID NO: 230)

AR-2954 Target: 5'-GATAAATTCCGAAGGAAAAATTGTCCA-3' (SEQ ID NO: 383)

5'-CGAAGGAAAAAUUGUCCAUCUUGUC$^{AC-3'}$ (SEQ ID NO: 3861)
3'-GCUUCCUUUUUAACAGGUAGAACAG$_{CA-5'}$ (SEQ ID NO: 231)

AR-2963 Target: 5'-CGAAGGAAAAATTGTCCATCTTGTCGT-3' (SEQ ID NO: 384)

5'-AUCUUGUCGUCUUCGGAAAUGUUAU$^{AC-3'}$ (SEQ ID NO: 3862)
3'-UAGAACAGCAGAAGCCUUUACAAUA$_{CU-5'}$ (SEQ ID NO: 232)

AR-2980 Target: 5'-ATCTTGTCGTCTTCGGAAATGTTATGA-3' (SEQ ID NO: 385)

5'-CGGAAAUGUUAUGAAGCAGGGAUGA$^{AC-3'}$ (SEQ ID NO: 3863)
3'-GCCUUUACAAUACUUCGUCCCUACU$_{GA-5'}$ (SEQ ID NO: 233)

AR-2993 Target: 5'-CGGAAATGTTATGAAGCAGGGATGACT-3' (SEQ ID NO: 386)

5'-GAAAUGUUAUGAAGCAGGGAUGACU$^{AC-3'}$ (SEQ ID NO: 3864)
3'-CUUUACAAUACUUCGUCCCUACUGA$_{GA-5'}$ (SEQ ID NO: 234)

AR-2995 Target: 5'-GAAATGTTATGAAGCAGGGATGACTCT-3' (SEQ ID NO: 387)

5'-CCCGGAAGCUGAAGAAACUUGGUAA$^{CA-3'}$ (SEQ ID NO: 3865)
3'-GGGCCUUCGACUUCUUUGAACCAUU$_{AG-5'}$ (SEQ ID NO: 235)

AR-3027 Target: 5'-CCCGGAAGCTGAAGAAACTTGGTAATC-3' (SEQ ID NO: 388)

5'-CGGAAGCUGAAGAAACUUGGUAAUC$^{CA-3'}$ (SEQ ID NO: 3866)
3'-GCCUUCGACUUCUUUGAACCAUUAG$_{AC-5'}$ (SEQ ID NO: 236)

AR-3029 Target: 5'-CGGAAGCTGAAGAAACTTGGTAATCTG-3' (SEQ ID NO: 389)

TABLE 5-continued

Selected Human Anti-AR 27mer "Blunt/Fray" DsiRNA Agents

5'-GCUGAAGAAACUUGGUAAUCUGAAA$^{AC}$-3'   (SEQ ID NO: 3867)
3'-CGACUUCUUUGAACCAUUAGACUUU$_{G}$-5'   (SEQ ID NO: 237)

AR-3034 Target: 5'-GCTGAAGAAACTTGGTAATCTGAAACT-3' (SEQ ID NO: 390)

5'-CUGAAGAAACUUGGUAAUCUGAAAC$^{CC}$-3'   (SEQ ID NO: 3868)
3'-GACUUCUUUGAACCAUUAGACUUUG$_{A U}$-5'   (SEQ ID NO: 238)

AR-3035 Target: 5'-CTGAAGAAACTTGGTAATCTGAAACTA-3' (SEQ ID NO: 391)

5'-UGAAGAAACUUGGUAAUCUGAAACU$^{CA}$-3'   (SEQ ID NO: 3869)
3'-ACUUCUUUGAACCAUUAGACUUUGA$_{U G}$-5'   (SEQ ID NO: 239)

AR-3036 Target: 5'-TGAAGAAACTTGGTAATCTGAAACTAC-3' (SEQ ID NO: 392)

5'-UUGGUAAUCUGAAACUACAGGAGGA$^{CA}$-3'   (SEQ ID NO: 3870)
3'-AACCAUUAGACUUUGAUGUCCUCCU$_{U C}$-5'   (SEQ ID NO: 240)

AR-3045 Target: 5'-TTGGTAATCTGAAACTACAGGAGGAAG-3' (SEQ ID NO: 393)

5'-AUCUGAAACUACAGGAGGAAGGAGA$^{AA}$-3'   (SEQ ID NO: 3871)
3'-UAGACUUUGAUGUCCUCCUUCCUCU$_{C}$-5'   (SEQ ID NO: 241)

AR-3051 Target: 5'-ATCTGAAACTACAGGAGGAAGGAGAGG-3' (SEQ ID NO: 394)

5'-CCCAGGAAUUCCUGUGCAUGAAAGC$^{CA}$-3'   (SEQ ID NO: 3872)
3'-GGGUCCUUAAGGACACGUACUUUCG$_{U G}$-5'   (SEQ ID NO: 242)

AR-3546 Target: 5'-CCCAGGAATTCCTGTGCATGAAAGCAC-3' (SEQ ID NO: 395)

5'-CCAGGAAUUCCUGUGCAUGAAAGCA$^{AC}$-3'   (SEQ ID NO: 3873)
3'-GGUCCUUAAGGACACGUACUUUCGU$_{G A}$-5'   (SEQ ID NO: 243)

AR-3547 Target: 5'-CCAGGAATTCCTGTGCATGAAAGCACT-3' (SEQ ID NO: 396)

5'-GUGGAUGGGCUGAAAAAUCAAAAAU$^{CA}$-3'   (SEQ ID NO: 3874)
3'-CACCUACCCGACUUUUUAGUUUUUA$_{A G}$-5'   (SEQ ID NO: 244)

AR-3596 Target: 5'-GTGGATGGGCTGAAAAATCAAAAATTC-3' (SEQ ID NO: 397)

5'-UGGAUGGGCUGAAAAAUCAAAAAUU$^{AC}$-3'   (SEQ ID NO: 3875)
3'-ACCUACCCGACUUUUUAGUUUUUAA$_{G A}$-5'   (SEQ ID NO: 245)

AR-3597 Target: 5'-TGGATGGGCTGAAAAATCAAAAATTCT-3' (SEQ ID NO: 398)

5'-GAUGGGCUGAAAAAUCAAAAAUUCU$^{CC}$-3'   (SEQ ID NO: 3876)
3'-CUACCCGACUUUUUAGUUUUUAAGA$_{A}$-5'   (SEQ ID NO: 246)

AR-3599 Target: 5'-GATGGGCTGAAAAATCAAAAATTCTTT-3' (SEQ ID NO: 399)

5'-GGCUGAAAAAUCAAAAAUUCUUUGA$^{CA}$-3'   (SEQ ID NO: 3877)
3'-CCGACUUUUUAGUUUUUAAGAAACU$_{A C}$-5'   (SEQ ID NO: 247)

AR-3603 Target: 5'-GGCTGAAAAATCAAAAATTCTTTGATG-3' (SEQ ID NO: 400)

5'-GCUGAAAAAUCAAAAAUUCUUUGAU$^{AC}$-3'   (SEQ ID NO: 3878)
3'-CGACUUUUUAGUUUUUAAGAAACUA$_{C U}$-5'   (SEQ ID NO: 248)

AR-3604 Target: 5'-GCTGAAAAATCAAAAATTCTTTGATGA-3' (SEQ ID NO: 401)

TABLE 5-continued

Selected Human Anti-AR 27mer "Blunt/Fray" DsiRNA Agents

5'-UGAAAAAUCAAAAAUUCUUUGAUGA$^{CA-3'}$ (SEQ ID NO: 3879)
3'-ACUUUUUAGUUUUUAAGAAACUACU$_{UG-5'}$ (SEQ ID NO: 249)

AR-3606 Target: 5'-TGAAAAATCAAAAATTCTTTGATGAAC-3' (SEQ ID NO: 402)

5'-GAAAAAUCAAAAAUUCUUUGAUGAA$^{AC-3'}$ (SEQ ID NO: 3880)
3'-CUUUUUAGUUUUUAAGAAACUACUU$_{GA-5'}$ (SEQ ID NO: 250)

AR-3607 Target: 5'-GAAAAATCAAAAATTCTTTGATGAACT-3' (SEQ ID NO: 403)

5'-AAAAAUCAAAAAUUCUUUGAUGAAC$^{CC-3'}$ (SEQ ID NO: 3881)
3'-UUUUUAGUUUUUAAGAAACUACUUG$_{AA-5'}$ (SEQ ID NO: 251)

AR-3608 Target: 5'-AAAAATCAAAAATTCTTTGATGAACTT-3' (SEQ ID NO: 404)

5'-UUCGAAUGAACUACAUCAAGGAACU$^{AA-3'}$ (SEQ ID NO: 3882)
3'-AAGCUUACUUGAUGUAGUUCCUUGA$_{GC-5'}$ (SEQ ID NO: 252)

AR-3633 Target: 5'-TTCGAATGAACTACATCAAGGAACTCG-3' (SEQ ID NO: 405)

5'-UCAAGGAACUCGAUCGUAUCAUUGC$^{CC-3'}$ (SEQ ID NO: 3883)
3'-AGUUCCUUGAGCUAGCAUAGUAACG$_{UA-5'}$ (SEQ ID NO: 253)

AR-3648 Target: 5'-TCAAGGAACTCGATCGTATCATTGCAT-3' (SEQ ID NO: 406)

5'-CAAGGAACUCGAUCGUAUCAUUGCA$^{CA-3'}$ (SEQ ID NO: 3884)
3'-GUUCCUUGAGCUAGCAUAGUAACGU$_{AC-5'}$ (SEQ ID NO: 254)

AR-3649 Target: 5'-CAAGGAACTCGATCGTATCATTGCATG-3' (SEQ ID NO: 407)

5'-AUCGUAUCAUUGCAUGCAAAAGAAA$^{CC-3'}$ (SEQ ID NO: 3885)
3'-UAGCAUAGUAACGUACGUUUUCUUU$_{UU-5'}$ (SEQ ID NO: 255)

AR-3660 Target: 5'-ATCGTATCATTGCATGCAAAAGAAAAA-3' (SEQ ID NO: 408)

5'-UCGUAUCAUUGCAUGCAAAAGAAAA$^{CC-3'}$ (SEQ ID NO: 3886)
3'-AGCAUAGUAACGUACGUUUUCUUUU$_{UU-5'}$ (SEQ ID NO: 256)

AR-3661 Target: 5'-TCGTATCATTGCATGCAAAAGAAAAA-3' (SEQ ID NO: 409)

5'-AUCAUUGCAUGCAAAAGAAAAAAUC$^{AA-3'}$ (SEQ ID NO: 3887)
3'-UAGUAACGUACGUUUUCUUUUUUAG$_{GG-5'}$ (SEQ ID NO: 257)

AR-3665 Target: 5'-ATCATTGCATGCAAAAGAAAAAATCCC-3' (SEQ ID NO: 410)

5'-CACUUUUGACCUGCUAAUCAAGUCA$^{AC-3'}$ (SEQ ID NO: 3888)
3'-GUGAAAACUGGACGAUUAGUUCAGU$_{GU-5'}$ (SEQ ID NO: 258)

AR-3772 Target: 5'-CACTTTTGACCTGCTAATCAAGTCACA-3' (SEQ ID NO: 411)

5'-GCGUGGACUUUCCGGAAAUGAUGGC$^{CA-3'}$ (SEQ ID NO: 3889)
3'-CGCACCUGAAAGGCCUUUACUACCG$_{UC-5'}$ (SEQ ID NO: 259)

AR-3807 Target: 5'-GCGTGGACTTTCCGGAAATGATGGCAG-3' SEQ ID NO: 412)

5'-CGUGGACUUUCCGGAAAUGAUGGCA$^{AC-3'}$ (SEQ ID NO: 3890)
3'-GCACCUGAAAGGCCUUUACUACCGU$_{CU-5'}$ (SEQ ID NO: 260)

AR-3808 Target: 5'-CGTGGACTTTCCGGAAATGATGGCAGA-3' (SEQ ID NO: 413)

TABLE 5-continued

Selected Human Anti-AR 27mer "Blunt/Fray" DsiRNA Agents

5'-UGAUGGCAGAGAUCAUCUCUGUGCA$^{CA-3'}$ (SEQ ID NO: 3891)
3'-ACUACCGUCUCUAGUAGAGACACGU$_{UC-5'}$ (SEQ ID NO: 261)

AR-3825 Target: 5'-TGATGGCAGAGATCATCTCTGTGCAAG-3' (SEQ ID NO: 414)

5'-GCAGAGAUCAUCUCUGUGCAAGUGC$^{AA-3'}$ (SEQ ID NO: 3892)
3'-CGUCUCUAGUAGAGACACGUUCACG$_{GG-5'}$ (SEQ ID NO: 262)

AR-3830 Target: 5'-GCAGAGATCATCTCTGTGCAAGTGCCC-3' (SEQ ID NO: 415)

5'-CAGAGAUCAUCUCUGUGCAAGUGCC$^{AC-3'}$ (SEQ ID NO: 3893)
3'-GUCUCUAGUAGAGACACGUUCACGG$_{GU-5'}$ (SEQ ID NO: 263)

AR-3831 Target: 5'-CAGAGATCATCTCTGTGCAAGTGCCCA-3' (SEQ ID NO: 416)

5'-CCCAAGAUCCUUUCUGGGAAAGUCA$^{CA-3'}$ (SEQ ID NO: 3894)
3'-GGGUUCUAGGAAAGACCCUUUCAGU$_{UC-5'}$ (SEQ ID NO: 264)

AR-3854 Target: 5'-CCCAAGATCCTTTCTGGGAAAGTCAAG-3' (SEQ ID NO: 417)

5'-GUGAAGCAUUGGAAACCCUAUUUCC$^{AA-3'}$ (SEQ ID NO: 3895)
3'-CACUUCGUAACCUUUGGGAUAAAGG$_{GG-5'}$ (SEQ ID NO: 265)

AR-3901 Target: 5'-GTGAAGCATTGGAAACCCTATTTCCCC-3' (SEQ ID NO: 418)

5'-CAGAUGUCUUCUGCCUGUUAUAACU$^{AC-3'}$ (SEQ ID NO: 3896)
3'-GUCUACAGAAGACGGACAAUAUUGA$_{GA-5'}$ (SEQ ID NO: 266)

AR-3949 Target: 5'-CAGATGTCTTCTGCCTGTTATAACTCT-3' (SEQ ID NO: 419)

5'-GCCUUGGGGAAUUUCCUCUAUUGAU$^{AC-3'}$ (SEQ ID NO: 3897)
3'-CGGAACCCCUUAAAGGAGAUAACUA$_{CA-5'}$ (SEQ ID NO: 267)

AR-3994 Target: 5'-GCCTTGGGGAATTTCCTCTATTGATGT-3' (SEQ ID NO: 420)

5'-CUUGGGGAAUUUCCUCUAUUGAUGU$^{CA-3'}$ (SEQ ID NO: 3898)
3'-GAACCCCUUAAAGGAGAUAACUACA$_{UG-5'}$ (SEQ ID NO: 268)

AR-3996 Target: 5'-CTTGGGGAATTTCCTCTATTGATGTAC-3' (SEQ ID NO: 421)

5'-UUGGGGAAUUUCCUCUAUUGAUGUA$^{AC-3'}$ (SEQ ID NO: 3899)
3'-AACCCCUUAAAGGAGAUAACUACAU$_{GU-5'}$ (SEQ ID NO: 269)

AR-3997 Target: 5'-TTGGGGAATTTCCTCTATTGATGTACA-3' (SEQ ID NO: 422)

5'-UGGGGAAUUUCCUCUAUUGAUGUAC$^{CA-3'}$ (SEQ ID NO: 3900)
3'-ACCCCUUAAAGGAGAUAACUACAUG$_{UC-5'}$ (SEQ ID NO: 270)

AR-3998 Target: 5'-TGGGGAATTTCCTCTATTGATGTACAG-3' (SEQ ID NO: 423)

5'-GGGGAAUUUCCUCUAUUGAUGUACA$^{AC-3'}$ (SEQ ID NO: 3901)
3'-CCCCUUAAAGGAGAUAACUACAUGU$_{CA-5'}$ (SEQ ID NO: 271)

AR-3999 Target: 5'-GGGGAATTTCCTCTATTGATGTACAGT-3' (SEQ ID NO: 424)

5'-CUAUUGAUGUACAGUCUGUCAUGAA$^{AC-3'}$ (SEQ ID NO: 3902)
3'-GAUAACUACAUGUCAGACAGUACUU$_{GU-5'}$ (SEQ ID NO: 272)

AR-4011 Target: 5'-CTATTGATGTACAGTCTGTCATGAACA-3' (SEQ ID NO: 425)

TABLE 5-continued

Selected Human Anti-AR 27mer "Blunt/Fray" DsiRNA Agents

5'-UAUUGAUGUACAGUCUGUCAUGAAC$^{cC-3'}$ (SEQ ID NO: 3903)
3'-AUAACUACAUGUCAGACAGUACUUG$_{U_{A-5'}}$ (SEQ ID NO: 273)

AR-4012 Target: 5'-TATTGATGTACAGTCTGTCATGAACAT-3' (SEQ ID NO: 426)

5'-AUUGAUGUACAGUCUGUCAUGAACA$^{cA-3'}$ (SEQ ID NO: 3904)
3'-UAACUACAUGUCAGACAGUACUUGU$_{A_{C-5'}}$ (SEQ ID NO: 274)

AR-4013 Target: 5'-ATTGATGTACAGTCTGTCATGAACATG-3' (SEQ ID NO: 427)

5'-AACAUGUUCCUGAAUUCUAUUUGCU$^{AA-3'}$ (SEQ ID NO: 3905)
3'-UUGUACAAGGACUUAAGAUAAACGA$_{C_{C-5'}}$ (SEQ ID NO: 275)

AR-4034 Target: 5'-AACATGTTCCTGAATTCTATTTGCTGG-3' (SEQ ID NO: 428)

5'-UUCUAUUUGCUGGGCUUUUUUUUC$^{cA-3'}$ (SEQ ID NO: 3906)
3'-AAGAUAAACGACCCGAAAAAAAAAG$_{A_{G-5'}}$ (SEQ ID NO: 276)

AR-4048 Target: 5'-TTCTATTTGCTGGGCTTTTTTTTCTC-3' (SEQ ID NO: 429)

5'-UCUAUUUGCUGGGCUUUUUUUUUCU$^{AC-3'}$ (SEQ ID NO: 3907)
3'-AGAUAAACGACCCGAAAAAAAAAGA$_{G_{A-5'}}$ (SEQ ID NO: 277)

AR-4049 Target: 5'-TCTATTTGCTGGGCTTTTTTTTCTCT-3' (SEQ ID NO: 430)

5'-UGCUGGGCUUUUUUUUCUCUUUCU$^{AC-3'}$ (SEQ ID NO: 3908)
3'-ACGACCCGAAAAAAAAAGAGAAAGA$_{G_{A-5'}}$ (SEQ ID NO: 278)

AR-4055 Target: 5'-TGCTGGGCTTTTTTTTCTCTTTCTCT-3' (SEQ ID NO: 431)

5'-UUUUUUUUCUCUUUCUCUCCUUUCU$^{cC-3'}$ (SEQ ID NO: 3909)
3'-AAAAAAAAGAGAAAGAGAGGAAAGA$_{A_{A-5'}}$ (SEQ ID NO: 279)

AR-4064 Target: 5'-TTTTTTTTCTCTTTCTCTCCTTTCTTT-3' (SEQ ID NO: 432)

5'-UUCAGACUUUGCUUCCCAUUGUGGC$^{cA-3'}$ (SEQ ID NO: 3910)
3'-AAGUCUGAAACGAAGGGUAACACCG$_{A_{G-5'}}$ (SEQ ID NO: 280)

AR-4128 Target: 5'-TTCAGACTTTGCTTCCCATTGTGGCTC-3' (SEQ ID NO: 433)

5'-UUGUGGCUCCUAUCUGUGUUUUGAA$^{cA-3'}$ (SEQ ID NO: 3911)
3'-AACACCGAGGAUAGACACAAAACUU$_{A_{C-5'}}$ (SEQ ID NO: 281)

AR-4146 Target: 5'-TTGTGGCTCCTATCTGTGTTTTGAATG-3' (SEQ ID NO: 434)

5'-UCCUAUCUGUGUUUUGAAUGGUGUU$^{AC-3'}$ (SEQ ID NO: 3912)
3'-AGGAUAGACACAAAACUUACCACAA$_{C_{A-5'}}$ (SEQ ID NO: 282)

AR-4153 Target: 5'-TCCTATCTGTGTTTTGAATGGTGTTGT-3' (SEQ ID NO: 435)

5'-AUCUGUGUUUUGAAUGGUGUUGUAU$^{AA-3'}$ (SEQ ID NO: 3913)
3'-UAGACACAAAACUUACCACAACAUA$_{C_{G-5'}}$ (SEQ ID NO: 283)

AR-4157 Target: 5'-ATCTGTGTTTTGAATGGTGTTGTATGC-3' (SEQ ID NO: 436)

5'-UGUGUUUUGAAUGGUGUUGUAUGCC$^{cC-3'}$ (SEQ ID NO: 3914)
3'-ACACAAAACUUACCACAACAUACGG$_{A_{A-5'}}$ (SEQ ID NO: 284)

AR-4160 Target: 5'-TGTGTTTTGAATGGTGTTGTATGCCTT-3' (SEQ ID NO: 437)

TABLE 5-continued

Selected Human Anti-AR 27mer "Blunt/Fray" DsiRNA Agents

5'-UGAAUGGUGUUGUAUGCCUUUAAAU$^{A}$$^{C-3'}$ (SEQ ID NO: 3915)
3'-ACUUACCACAACAUACGGAAAUUUA$_{G}$$_{A-5'}$ (SEQ ID NO: 285)

AR-4167 Target: 5'-TGAATGGTGTTGTATGCCTTTAAATCT-3' (SEQ ID NO: 438)

5'-GAAUGGUGUUGUAUGCCUUUAAAUC$^{C}$$^{A-3'}$ (SEQ ID NO: 3916)
3'-CUUACCACAACAUACGGAAAUUUAG$_{A}$$_{C-5'}$ (SEQ ID NO: 286)

AR-4168 Target: 5'-GAATGGTGTTGTATGCCTTTAAATCTG-3' (SEQ ID NO: 439)

5'-UGUUGUAUGCCUUUAAAUCUGUGAU$^{A}$$^{C-3'}$ (SEQ ID NO: 3917)
3'-ACAACAUACGGAAAUUUAGACACUA$_{C}$$_{U-5'}$ (SEQ ID NO: 287)

AR-4174 Target: 5'-TGTTGTATGCCTTTAAATCTGTGATGA-3' (SEQ ID NO: 440)

5'-UUGUAUGCCUUUAAAUCUGUGAUGA$^{C}$$^{A-3'}$ (SEQ ID NO: 3918)
3'-AACAUACGGAAAUUUAGACACUACU$_{A}$$_{G-5'}$ (SEQ ID NO: 288)

AR-4176 Target: 5'-TTGTATGCCTTTAAATCTGTGATGATC-3' (SEQ ID NO: 441)

5'-UGUAUGCCUUUAAAUCUGUGAUGAU$^{A}$$^{A-3'}$ (SEQ ID NO: 3919)
3'-ACAUACGGAAAUUUAGACACUACUA$_{G-5'}$ (SEQ ID NO: 289)

AR-4177 Target: 5'-TGTATGCCTTTAAATCTGTGATGATCC-3' (SEQ ID NO: 442)

5'-CCCAGUGUCAAGUUGUGCUUGUUUA$^{A}$$^{C-3'}$ (SEQ ID NO: 3920)
3'-GGGUCACAGUUCAACACGAACAAAU$_{G}$$_{U-5'}$ (SEQ ID NO: 290)

AR-4212 Target: 5'-CCCAGTGTCAAGTTGTGCTTGTTTACA-3' (SEQ ID NO: 443)

5'-CCAGUGUCAAGUUGUGCUUGUUUAC$^{C}$$^{A-3'}$ (SEQ ID NO: 3921)
3'-GGUCACAGUUCAACACGAACAAAUG$_{U}$$_{C-5'}$ (SEQ ID NO: 291)

AR-4213 Target: 5'-CCAGTGTCAAGTTGTGCTTGTTTACAG-3' (SEQ ID NO: 444)

5'-GCUUGUUUACAGCACUACUCUGUGC$^{A}$$^{C-3'}$ (SEQ ID NO: 3922)
3'-CGAACAAAUGUCGUGAUGAGACACG$_{G}$$_{U-5'}$ (SEQ ID NO: 292)

AR-4228 Target: 5'-GCTTGTTTACAGCACTACTCTGTGCCA-3' (SEQ ID NO: 445)

5'-CUUGUUUACAGCACUACUCUGUGCC$^{C}$$^{A-3'}$ (SEQ ID NO: 3923)
3'-GAACAAAUGUCGUGAUGAGACACGG$_{U}$$_{C-5'}$ (SEQ ID NO: 293)

AR-4229 Target: 5'-CTTGTTTACAGCACTACTCTGTGCCAG-3' (SEQ ID NO: 446)

5'-CACAAACGUUUACUUAUCUUAUGCC$^{C}$$^{A-3'}$ (SEQ ID NO: 3924)
3'-GUGUUUGCAAAUGAAUAGAAUACGG$_{U}$$_{G-5'}$ (SEQ ID NO: 294)

AR-4259 Target: 5'-CACAAACGTTTACTTATCTTATGCCAC-3' (SEQ ID NO: 447)

5'-CACGGGAAGUUUAGAGAGCUAAGAU$^{C}$$^{C-3'}$ (SEQ ID NO: 3925)
3'-GUGCCCUUCAAAUCUCUCGAUUCUA$_{A}$$_{U-5'}$ (SEQ ID NO: 295)

AR-4283 Target: 5'-CACGGGAAGTTTAGAGAGCTAAGATTA-3' (SEQ ID NO: 448)

5'-ACGGGAAGUUUAGAGAGCUAAGAUU$^{C}$$^{C-3'}$ (SEQ ID NO: 3926)
3'-UGCCCUUCAAAUCUCUCGAUUCUAA$_{U}$$_{A-5'}$ (SEQ ID NO: 296)

AR-4284 Target: 5'-ACGGGAAGTTTAGAGAGCTAAGATTAT-3' (SEQ ID NO: 449)

TABLE 5-continued

Selected Human Anti-AR 27mer "Blunt/Fray" DsiRNA Agents

5'-CGGGAAGUUUAGAGAGCUAAGAUUA$^{CA-3'}$ (SEQ ID NO: 3927)
3'-GCCCUUCAAAUCUCUCGAUUCUAAU$_{AG-5'}$ (SEQ ID NO: 297)

AR-4285 Target: 5'-CGGGAAGTTTAGAGAGCTAAGATTATC-3' (SEQ ID NO: 450)

5'-GGGAAGUUUAGAGAGCUAAGAUUAU$^{AC-3'}$ (SEQ ID NO: 3928)
3'-CCCUUCAAAUCUCUCGAUUCUAAUA$_{GA-5'}$ (SEQ ID NO: 298)

AR-4286 Target: 5'-GGGAAGTTTAGAGAGCTAAGATTATCT-3' (SEQ ID NO: 451)

5'-GAAGUUUAGAGAGCUAAGAUUAUCU$^{AA-3'}$ (SEQ ID NO: 3929)
3'-CUUCAAAUCUCUCGAUUCUAAUAGA$_{CC-5'}$ (SEQ ID NO: 299)

AR-4288 Target: 5'-GAAGTTTAGAGAGCTAAGATTATCTGG-3' (SEQ ID NO: 452)

5'-UUAGAGAGCUAAGAUUAUCUGGGGA$^{CC-3'}$ (SEQ ID NO: 3930)
3'-AAUCUCUCGAUUCUAAUAGACCCCU$_{UU-5'}$ (SEQ ID NO: 300)

AR-4293 Target: 5'-TTAGAGAGCTAAGATTATCTGGGAAA-3' (SEQ ID NO: 453)

5'-UAGAGAGCUAAGAUUAUCUGGGGAA$^{CC-3'}$ (SEQ ID NO: 3931)
3'-AUCUCUCGAUUCUAAUAGACCCCUU$_{UA-5'}$ (SEQ ID NO: 301)

AR-4294 Target: 5'-TAGAGAGCTAAGATTATCTGGGGAAAT-3' (SEQ ID NO: 454)

5'-AGAGAGCUAAGAUUAUCUGGGGAAA$^{CA-3'}$ (SEQ ID NO: 3932)
3'-UCUCUCGAUUCUAAUAGACCCCUUU$_{AG-5'}$ (SEQ ID NO: 302)

AR-4295 Target: 5'-AGAGAGCTAAGATTATCTGGGGAAATC-3' (SEQ ID NO: 455)

5'-UAAGAUUAUCUGGGGAAAUCAAAAC$^{CC-3'}$ (SEQ ID NO: 3933)
3'-AUUCUAAUAGACCCCUUUAGUUUUG$_{UU-5'}$ (SEQ ID NO: 303)

AR-4302 Target: 5'-TAAGATTATCTGGGGAAATCAAAACAA-3' (SEQ ID NO: 456)

5'-AAGAUUAUCUGGGGAAAUCAAAACA$^{CC-3'}$ (SEQ ID NO: 3934)
3'-UUCUAAUAGACCCCUUUAGUUUUGU$_{UU-5'}$ (SEQ ID NO: 304)

AR-4303 Target: 5'-AAGATTATCTGGGGAAATCAAAACAAA-3' (SEQ ID NO: 457)

5'-AUCUGGGGAAAUCAAAACAAAAACA$^{CA-3'}$ (SEQ ID NO: 3935)
3'-UAGACCCCUUUAGUUUUGUUUUUGU$_{UC-5'}$ (SEQ ID NO: 305)

AR-4309 Target: 5'-ATCTGGGGAAATCAAAACAAAAACAAG-3' (SEQ ID NO: 458)

5'-GGGGAAAUCAAAACAAAAACAAGCA$^{CC-3'}$ (SEQ ID NO: 3936)
3'-CCCCUUUAGUUUUGUUUUUGUUCGU$_{UU-5'}$ (SEQ ID NO: 306)

AR-4313 Target: 5'-GGGGAAATCAAAACAAAAACAAGCAAA-3' (SEQ ID NO: 459)

5'-GUGAAGUUUUUAAAAGCUGCUAAAG$^{CA-3'}$ (SEQ ID NO: 3937)
3'-CACUUCAAAAAUUUUCGACGAUUUC$_{UG-5'}$ (SEQ ID NO: 796)

AR-251 Target: 5'-GTGAAGTTTTTAAAAGCTGCTAAAGAC-3' (SEQ ID NO: 826)

5'-AGCUAGCUGCACAUUGCAAAGAAGG$^{AC-3'}$ (SEQ ID NO: 3938)
3'-UCGAUCGACGUGUAACGUUUCUUCC$_{GA-5'}$ (SEQ ID NO: 797)

AR-524 Target: 5'-AGCTAGCTGCACATTGCAAAGAAGGCT-3' (SEQ ID NO: 827)

TABLE 5-continued

Selected Human Anti-AR 27mer "Blunt/Fray" DsiRNA Agents

5'-ACAUUGCAAAGAAGGCUCUUAGGAG$^{A}$$^{A-3'}$ (SEQ ID NO: 3939)
3'-UGUAACGUUUCUUCCGAGAAUCCUC$_{G}$$_{G-5'}$ (SEQ ID NO: 798)

AR-534 Target: 5'-ACATTGCAAAGAAGGCTCTTAGGAGCC-3' (SEQ ID NO: 828)

5'-AACAAAACAAACAAAAACAAAAAAG$^{A}$$^{A-3'}$ (SEQ ID NO: 3940)
3'-UUGUUUUGUUUGUUUUUGUUUUUUC$_{G}$$_{G-5'}$ (SEQ ID NO: 799)

AR-736 Target: 5'-AACAAAACAAACAAAAACAAAAAGCC-3' (SEQ ID NO: 829)

5'-AAGAUAAUAACUCAGUUCUUAUUUG$^{A}$$^{C-3'}$ (SEQ ID NO: 3941)
3'-UUCUAUUAUUGAGUCAAGAAUAAAC$_{G}$$_{U-5'}$ (SEQ ID NO: 800)

AR-776 Target: 5'-AAGATAATAACTCAGTTCTTATTTGCA-3' (SEQ ID NO: 830)

5'-UUCAGUGGACACUGAAUUUGGAAGG$^{C}$$^{A-3'}$ (SEQ ID NO: 3942)
3'-AAGUCACCUGUGACUUAAACCUUCC$_{A}$$_{C-5'}$ (SEQ ID NO: 801)

AR-808 Target: 5'-TTCAGTGGACACTGAATTTGGAAGGTG-3' (SEQ ID NO: 831)

5'-CAGUGGACACUGAAUUUGGAAGGUG$^{A}$$^{C-3'}$ (SEQ ID NO: 3943)
3'-GUCACCUGUGACUUAAACCUUCCAC$_{C}$$_{U-5'}$ (SEQ ID NO: 802)

AR-810 Target: 5'-CAGTGGACACTGAATTTGGAAGGTGGA-3' (SEQ ID NO: 832)

5'-AGUGGACACUGAAUUUGGAAGGUGG$^{C}$$^{A-3'}$ (SEQ ID NO: 3944)
3'-UCACCUGUGACUUAAACCUUCCACC$_{U}$$_{C-5'}$ (SEQ ID NO: 803)

AR-811 Target: 5'-AGTGGACACTGAATTTGGAAGGTGGAG-3' (SEQ ID NO: 833)

5'-UUGAAUCUACCCUUCAAGUAUUAAG$^{C}$$^{A-3'}$ (SEQ ID NO: 3945)
3'-AACUUAGAUGGGAAGUUCAUAAUUC$_{U}$$_{C-5'}$ (SEQ ID NO: 804)

AR-873 Target: 5'-TTGAATCTACCCTTCAAGTATTAAGAG-3' (SEQ ID NO: 834)

5'-CAAGUAUUAAGAGACAGACUGUGAG$^{A}$$^{A-3'}$ (SEQ ID NO: 3946)
3'-GUUCAUAAUUCUCUGUCUGACACUC$_{G}$$_{G-5'}$ (SEQ ID NO: 805)

AR-887 Target: 5'-CAAGTATTAAGAGACAGACTGTGAGCC-3' (SEQ ID NO: 835)

5'-GCUGAGUAUUCCCCUUUCAAGGGAG$^{A}$$^{C-3'}$ (SEQ ID NO: 3947)
3'-CGACUCAUAAGGGGAAAGUUCCCUC$_{C}$$_{A-5'}$ (SEQ ID NO: 806)

AR-2060 Target: 5'-GCTGAGTATTCCCCTTTCAAGGGAGGT-3' (SEQ ID NO: 836)

5'-CUGAGUAUUCCCCUUUCAAGGGAGG$^{C}$$^{C-3'}$ (SEQ ID NO: 3948)
3'-GACUCAUAAGGGGAAAGUUCCCUCC$_{A}$$_{A-5'}$ (SEQ ID NO: 807)

AR-2061 Target: 5'-CTGAGTATTCCCCTTTCAAGGGAGGTT-3' (SEQ ID NO: 837)

5'-UCUGUGGAGAUGAAGCUUCUGGGUG$^{C}$$^{A-3'}$ (SEQ ID NO: 3949)
3'-AGACACCUCUACUUCGAAGACCCAC$_{A}$$_{G-5'}$ (SEQ ID NO: 808)

AR-2826 Target: 5'-TCTGTGGAGATGAAGCTTCTGGGTGTC-3' (SEQ ID NO: 838)

5'-GAAGGGAAACAGAAGUACCUGUGCG$^{A}$$^{A-3'}$ (SEQ ID NO: 3950)
3'-CUUCCCUUUGUCUUCAUGGACACGC$_{G}$$_{G-5'}$ (SEQ ID NO: 809)

AR-2906 Target: 5'-GAAGGGAAACAGAAGTACCTGTGCGCC-3' (SEQ ID NO: 839)

TABLE 5-continued

Selected Human Anti-AR 27mer "Blunt/Fray" DsiRNA Agents

5'-UUGAUAAAUUCCGAAGGAAAAAUUG$^{CA-3'}$ (SEQ ID NO: 3951)
3'-AACUAUUUAAGGCUUCCUUUUUAAC$_{AG-5'}$ (SEQ ID NO: 810)

AR-2952 Target: 5'-TTGATAAATTCCGAAGGAAAAATTGTC-3' (SEQ ID NO: 840)

5'-GAAGGAAAAAUUGUCCAUCUUGUCG$^{CA-3'}$ (SEQ ID NO: 3952)
3'-CUUCCUUUUUAACAGGUAGAACAGC$_{AG-5'}$ (SEQ ID NO: 811)

AR-2964 Target: 5'-GAAGGAAAAATTGTCCATCTTGTCGTC-3' (SEQ ID NO: 841)

5'-UCGGAAAUGUUAUGAAGCAGGGAUG$^{CA-3'}$ (SEQ ID NO: 3953)
3'-AGCCUUUACAAUACUUCGUCCCUAC$_{UG-5'}$ (SEQ ID NO: 812)

AR-2992 Target: 5'-TCGGAAATGTTATGAAGCAGGGATGAC-3' (SEQ ID NO: 842)

5'-ACUUGGUAAUCUGAAACUACAGGAG$^{AC-3'}$ (SEQ ID NO: 3954)
3'-UGAACCAUUAGACUUUGAUGUCCUC$_{CU-5'}$ (SEQ ID NO: 813)

AR-3043 Target: 5'-ACTTGGTAATCTGAAACTACAGGAGGA-3' (SEQ ID NO: 843)

5'-CUUGGUAAUCUGAAACUACAGGAGG$^{CC-3'}$ (SEQ ID NO: 3955)
3'-GAACCAUUAGACUUUGAUGUCCUCC$_{UU-5'}$ (SEQ ID NO: 814)

AR-3044 Target: 5'-CTTGGTAATCTGAAACTACAGGAGGAA-3' (SEQ ID NO: 844)

5'-GGUAAUCUGAAACUACAGGAGGAAG$^{AC-3'}$ (SEQ ID NO: 3956)
3'-CCAUUAGACUUUGAUGUCCUCCUUC$_{CU-5'}$ (SEQ ID NO: 815)

AR-3047 Target: 5'-GGTAATCTGAAACTACAGGAGGAAGA-3' (SEQ ID NO: 845)

5'-AGCUGACAGUGUCACACAUUGAAGG$^{AC-3'}$ (SEQ ID NO: 3957)
3'-UCGACUGUCACAGUGUGUAACUUCC$_{GA-5'}$ (SEQ ID NO: 816)

AR-3117 Target: 5'-AGCTGACAGTGTCACACATTGAAGGCT-3' (SEQ ID NO: 846)

5'-GGCUGUCAUUCAGUACUCCUGGAUG$^{AA-3'}$ (SEQ ID NO: 3958)
3'-CCGACAGUAAGUCAUGAGGACCUAC$_{CC-5'}$ (SEQ ID NO: 817)

AR-3346 Target: 5'-GGCTGTCATTCAGTACTCCTGGATGGG-3' (SEQ ID NO: 847)

5'-CUGAAAAAUCAAAAAUUCUUUGAUG$^{CC-3'}$ (SEQ ID NO: 3959)
3'-GACUUUUUAGUUUUUAAGAAACUAC$_{UU-5'}$ (SEQ ID NO: 818)

AR-3605 Target: 5'-CTGAAAAATCAAAAATTCTTTGATGAA-3' (SEQ ID NO: 848)

5'-AAAAUUCUUUGAUGAACUUCGAAUG$^{CC-3'}$ (SEQ ID NO: 3960)
3'-UUUUAAGAAACUACUUGAAGCUUAC$_{UU-5'}$ (SEQ ID NO: 819)

AR-3616 Target: 5'-AAAATTCTTTGATGAACTTCGAATGAA-3' (SEQ ID NO: 849)

5'-UGCUAAUCAAGUCACACAUGGUGAG$^{AA-3'}$ (SEQ ID NO: 3961)
3'-ACGAUUAGUUCAGUGUGUACCACUC$_{GC-5'}$ (SEQ ID NO: 820)

AR-3783 Target: 5'-TGCTAATCAAGTCACACATGGTGAGCG-3' (SEQ ID NO: 850)

5'-AGCGUGGACUUUCCGGAAAUGAUGG$^{AC-3'}$ (SEQ ID NO: 3962)
3'-UCGCACCUGAAAGGCCUUUACUACC$_{GU-5'}$ (SEQ ID NO: 821)

AR-3806 Target: 5'-AGCGTGGACTTTCCGGAAATGATGGCA-3' (SEQ ID NO: 851)

TABLE 5-continued

Selected Human Anti-AR 27mer "Blunt/Fray" DsiRNA Agents

5'-CCUUGGGGAAUUUCCUCUAUUGAUG<sup>CC-3'</sup> (SEQ ID NO: 3963)
3'-GGAACCCCUUAAAGGAGAUAACUAC<sub>AU-5'</sub> (SEQ ID NO: 822)

AR-3995 Target: 5'-CCTTGGGGAATTTCCTCTATTGATGTA-3' (SEQ ID NO: 852)

5'-UCUGUGUUUUGAAUGGUGUUGUAUG<sup>AA-3'</sup> (SEQ ID NO: 3964)
3'-AGACACAAAACUUACCACAACAUAC<sub>GG-5'</sub> (SEQ ID NO: 823)

AR-4158 Target: 5'-TCTGTGTTTTGAATGGTGTTGTATGCC-3' (SEQ ID NO: 853)

5'-GUUGUAUGCCUUUAAAUCUGUGAUG<sup>CC-3'</sup> (SEQ ID NO: 3965)
3'-CAACAUACGGAAAUUUAGACACUAC<sub>UA-5'</sub> (SEQ ID NO: 824)

AR-4175 Target: 5'-GTTGTATGCCTTTAAATCTGTGATGAT-3' (SEQ ID NO: 854)

5'-UUUAGAGAGCUAAGAUUAUCUGGGG<sup>CC-3'</sup> (SEQ ID NO: 3966)
3'-AAAUCUCUCGAUUCUAAUAGACCCC<sub>UU-5'</sub> (SEQ ID NO: 825)

AR-4292 Target: 5'-TTTAGAGAGCTAAGATTATCTGGGGAA-3' (SEQ ID NO: 855)

5'-UCGGUGAAGUUUUUAAAAGCUGCUA<sup>CC-3'</sup> (SEQ ID NO: 3967)
3'-AGCCACUUCAAAAAUUUUCGACGAU<sub>UU-5'</sub> (SEQ ID NO: 970)

AR-248 Target: 5'-TCGGTGAAGTTTTTAAAAGCTGCTAAA-3' (SEQ ID NO: 1024)

5'-AGUUUUUAAAAGCUGCUAAAGACUC<sup>AA-3'</sup> (SEQ ID NO: 3968)
3'-UCAAAAAUUUUCGACGAUUUCUGAG<sub>CC-5'</sub> (SEQ ID NO: 971)

AR-255 Target: 5'-AGTTTTTAAAAGCTGCTAAAGACTCGG-3' (SEQ ID NO: 1025)

5'-GCAGAGAGGUAACUCCCUUUGGCUG<sup>AA-3'</sup> (SEQ ID NO: 3969)
3'-CGUCUCUCCAUUGAGGGAAACCGAC<sub>GC-5'</sub> (SEQ ID NO: 972)

AR-489 Target: 5'-GCAGAGAGGTAACTCCCTTTGGCTGCG-3' (SEQ ID NO: 1026)

5'-CAGAGAUCAAAAGAUGAAAAGGCAG<sup>CA-3'</sup> (SEQ ID NO: 3970)
3'-GUCUCUAGUUUUCUACUUUUCCGUC<sub>AG-5'</sub> (SEQ ID NO: 973)

AR-690 Target: 5'-CAGAGATCAAAAGATGAAAAGGCAGTC-3' (SEQ ID NO: 1027)

5'-CAAAAAACAAAACAAACAAAAACAA<sup>CC-3'</sup> (SEQ ID NO: 3971)
3'-GUUUUUUGUUUUGUUUGUUUUUGUU<sub>UU-5'</sub> (SEQ ID NO: 974)

AR-731 Target: 5'-CAAAAAACAAAACAAACAAAAACAAAA-3' (SEQ ID NO: 1028)

5'-AAAUAAAAGAAAAAGAUAAUAACUC<sup>CA-3'</sup> (SEQ ID NO: 3972)
3'-UUUAUUUUCUUUUUCUAUUAUUGAG<sub>UC-5'</sub> (SEQ ID NO: 975)

AR-764 Target: 5'-AAATAAAAGAAAAAGATAATAACTCAG-3' (SEQ ID NO: 1029)

5'-AGAAAAAGAUAAUAACUCAGUUCUU<sup>CC-3'</sup> (SEQ ID NO: 3973)
3'-UCUUUUUCUAUUAUUGAGUCAAGAA<sub>UA-5'</sub> (SEQ ID NO: 976)

AR-771 Target: 5'-AGAAAAAGATAATAACTCAGTTCTTAT-3' (SEQ ID NO: 1030)

5'-AUAAUAACUCAGUUCUUAUUUGCAC<sup>AC-3'</sup> (SEQ ID NO: 3974)
3'-UAUUAUUGAGUCAAGAAUAAACGUG<sub>GA-5'</sub> (SEQ ID NO: 977)

AR-779 Target: 5'-ATAATAACTCAGTTCTTATTTGCACCT-3' (SEQ ID NO: 1031)

TABLE 5-continued

Selected Human Anti-AR 27mer "Blunt/Fray" DsiRNA Agents

5'-AGGUGGAGGAUUUGUUUUUUCUU$^{\text{C}^{\text{C-3'}}}$ (SEQ ID NO: 3975)
3'-UCCACCUCCUAAAACAAAAAAGAA$_{\text{A-5'}}^{\text{A}}$ (SEQ ID NO: 978)

AR-830 Target: 5'-AGGTGGAGGATTTGTTTTTTCTTTT-3' (SEQ ID NO: 1032)

5'-UUUUGUUUUUUCUUUUAAGAUCUG$^{\text{A}^{\text{A-3'}}}$ (SEQ ID NO: 3976)
3'-AAAACAAAAAAGAAAAUUCUAGAC$_{\text{C-5'}}^{\text{C}}$ (SEQ ID NO: 979)

AR-840 Target: 5'-TTTTGTTTTTTCTTTTAAGATCTGGG-3' (SEQ ID NO: 1033)

5'-UUUUUUUCUUUUAAGAUCUGGGCAU$^{\text{A}^{\text{C-3'}}}$ (SEQ ID NO: 3977)
3'-AAAAAAAGAAAAUUCUAGACCCGUA$_{\text{A-5'}}^{\text{G}}$ (SEQ ID NO: 980)

AR-845 Target: 5'-TTTTTTTCTTTTAAGATCTGGGCATCT-3' (SEQ ID NO: 1034)

5'-AUCUGGGCAUCUUUUGAAUCUACCC$^{\text{C}^{\text{C-3'}}}$ (SEQ ID NO: 3978)
3'-UAGACCCGUAGAAAACUUAGAUGGG$_{\text{A-5'}}^{\text{A}}$ (SEQ ID NO: 981)

AR-860 Target: 5'-ATCTGGGCATCTTTTGAATCTACCCTT-3' (SEQ ID NO: 1035)

5'-UAAGGGAAGUAGGUGGAAGAUUCAG$^{\text{A}^{\text{A-3'}}}$ (SEQ ID NO: 3979)
3'-AUUCCCUUCAUCCACCUUCUAAGUC$_{\text{G-5'}}^{\text{G}}$ (SEQ ID NO: 982)

AR-1105 Target: 5'-TAAGGGAAGTAGGTGGAAGATTCAGCC-3' (SEQ ID NO: 1036)

5'-GAGGAGCUUUCCAGAAUCUGUUCCA$^{\text{A}^{\text{C-3'}}}$ (SEQ ID NO: 3980)
3'-CUCCUCGAAAGGUCUUAGACAAGGU$_{\text{U-5'}}^{\text{C}}$ (SEQ ID NO: 983)

AR-1200 Target: 5'-GAGGAGCTTTCCAGAATCTGTTCCAGA-3' (SEQ ID NO: 1037)

5'-AGCAGGAAGCAGUAUCCGAAGGCAG$^{\text{A}^{\text{C-3'}}}$ (SEQ ID NO: 3981)
3'-UCGUCCUUCGUCAUAGGCUUCCGUC$_{\text{U-5'}}^{\text{G}}$ (SEQ ID NO: 984)

AR-1734 Target: 5'-AGCAGGAAGCAGTATCCGAAGGCAGCA-3' (SEQ ID NO: 1038)

5'-CCAAGGACAAUUACUUAGGGGGCAC$^{\text{C}^{\text{C-3'}}}$ (SEQ ID NO: 3982)
3'-GGUUCCUGUUAAUGAAUCCCCCGUG$_{\text{A-5'}}^{\text{A}}$ (SEQ ID NO: 985)

AR-1803 Target: 5'-CCAAGGACAATTACTTAGGGGGCACTT-3' (SEQ ID NO: 1039)

5'-AAGGAGUUGUGUAAGGCAGUGUCGG$^{\text{C}^{\text{A-3'}}}$ (SEQ ID NO: 3983)
3'-UUCCUCAACACAUUCCGUCACAGCC$_{\text{C-5'}}^{\text{A}}$ (SEQ ID NO: 986)

AR-1850 Target: 5'-AAGGAGTTGTGTAAGGCAGTGTCGGTG-3' SEQ ID NO: 1040)

5'-GGCAAGAGCACUGAAGAUACUGCUG$^{\text{C}^{\text{A-3'}}}$ (SEQ ID NO: 3984)
3'-CCGUUCUCGUGACUUCUAUGACGAC$_{\text{C-5'}}^{\text{U}}$ (SEQ ID NO: 987)

AR-2039 Target: 5'-GGCAAGAGCACTGAAGATACTGCTGAG-3' (SEQ ID NO: 1041)

5'-ACUGAAGAUACUGCUGAGUAUUCCC$^{\text{A}^{\text{C-3'}}}$ (SEQ ID NO: 3985)
3'-UGACUUCUAUGACGACUCAUAAGGG$_{\text{A-5'}}^{\text{G}}$ (SEQ ID NO: 988)

AR-2048 Target: 5'-ACTGAAGATACTGCTGAGTATTCCCT-3' (SEQ ID NO: 1042)

5'-CAAGGGAGGUUACACCAAAGGGCUA$^{\text{A}^{\text{C-3'}}}$ (SEQ ID NO: 3986)
3'-GUUCCCUCCAAUGUGGUUUCCCGAU$_{\text{U-5'}}^{\text{C}}$ (SEQ ID NO: 989)

AR-2077 Target: 5'-CAAGGGAGGTTACACCAAAGGGCTAGA-3' (SEQ ID NO: 1043)

TABLE 5-continued

Selected Human Anti-AR 27mer "Blunt/Fray" DsiRNA Agents

5'-CUUGUGUCAAAAGCGAAAUGGGCCC$^{AC-3'}$ (SEQ ID NO: 3987)
3'-GAACACAGUUUUCGCUUUACCCGGG$_{GA-5'}$ (SEQ ID NO: 990)

AR-2694 Target: 5'-CTTGTGTCAAAAGCGAAATGGGCCCCT-3' (SEQ ID NO: 1044)

5'-AUGUUUUGCCCAUUGACUAUUACUU$^{cA-3'}$ (SEQ ID NO: 3988)
3'-UACAAAACGGGUAACUGAUAAUGAA$_{AG-5'}$ (SEQ ID NO: 991)

AR-2778 Target: 5'-ATGTTTTGCCCATTGACTATTACTTTC-3' (SEQ ID NO: 1045)

5'-UGCAAGGUCUUCUUCAAAAGAGCCG$^{AC-3'}$ (SEQ ID NO: 3989)
3'-ACGUUCCAGAAGAAGUUUUCUCGGC$_{GA-5'}$ (SEQ ID NO: 992)

AR-2879 Target: 5'-TGCAAGGTCTTCTTCAAAAGAGCCGCT-3' (SEQ ID NO: 1046)

5'-AAGGGAAACAGAAGUACCUGUGCGC$^{AC-3'}$ (SEQ ID NO: 3990)
3'-UUCCCUUUGUCUUCAUGGACACGCG$_{GU-5'}$ (SEQ ID NO: 993)

AR-2907 Target: 5'-AAGGGAAACAGAAGTACCTGTGCGCCA-3' (SEQ ID NO: 1047)

5'-AUGAUUGCACUAUUGAUAAAUUCCG$^{cC-3'}$ (SEQ ID NO: 3991)
3'-UACUAACGUGAUAACUAUUUAAGGC$_{UU-5'}$ (SEQ ID NO: 994)

AR-2940 Target: 5'-ATGATTGCACTATTGATAAATTCCGAA-3' (SEQ ID NO: 1048)

5'-UAAAUUCCGAAGGAAAAAUUGUCCA$^{cA-3'}$ (SEQ ID NO: 3992)
3'-AUUUAAGGCUUCCUUUUUAACAGGU$_{AG-5'}$ (SEQ ID NO: 995)

AR-2956 Target: 5'-TAAATTCCGAAGGAAAAATTGTCCATC-3' (SEQ ID NO: 1049)

5'-AAGGAAAAAUUGUCCAUCUUGUCGU$^{AC-3'}$ (SEQ ID NO: 3993)
3'-UUCCUUUUUAACAGGUAGAACAGCA$_{GA-5'}$ (SEQ ID NO: 996)

AR-2965 Target: 5'-AAGGAAAAATTGTCCATCTTGTCGTCT-3' (SEQ ID NO: 1050)

5'-GAAAAAUUGUCCAUCUUGUCGUCUU$^{AA-3'}$ (SEQ ID NO: 3994)
3'-CUUUUUAACAGGUAGAACAGCAGAA$_{GC-5'}$ (SEQ ID NO: 997)

AR-2968 Target: 5'-GAAAAATTGTCCATCTTGTCGTCTTCG-3' (SEQ ID NO: 1051)

5'-GAAGAAACUUGGUAAUCUGAAACUA$^{AC-3'}$ (SEQ ID NO: 3995)
3'-CUUCUUUGAACCAUUAGACUUUGAU$_{GU-5'}$ (SEQ ID NO: 998)

AR-3037 Target: 5'-GAAGAAACTTGGTAATCTGAAACTACA-3' (SEQ ID NO: 1052)

5'-CAUUGAAGGCUAUGAAUGUCAGCCC$^{cC-3'}$ (SEQ ID NO: 3996)
3'-GUAACUUCCGAUACUUACAGUCGGG$_{UA-5'}$ (SEQ ID NO: 999)

AR-3133 Target: 5'-CATTGAAGGCTATGAATGTCAGCCCAT-3' (SEQ ID NO: 1053)

5'-CAGGAAUUCCUGUGCAUGAAAGCAC$^{cA-3'}$ (SEQ ID NO: 3997)
3'-GUCCUUAAGGACACGUACUUUCGUG$_{AC-5'}$ (SEQ ID NO: 1000)

AR-3548 Target: 5'-CAGGAATTCCTGTGCATGAAAGCACTG-3' (SEQ ID NO: 1054)

5'-UCAAAAAUUCUUUGAUGAACUUCGA$^{cC-3'}$ (SEQ ID NO: 3998)
3'-AGUUUUUAAGAAACUACUUGAAGCU$_{UA-5'}$ (SEQ ID NO: 1001)

AR-3613 Target: 5'-TCAAAAATTCTTTGATGAACTTCGAAT-3' (SEQ ID NO: 1055)

TABLE 5-continued

Selected Human Anti-AR 27mer "Blunt/Fray" DsiRNA Agents

5'-UCUUUGAUGAACUUCGAAUGAACUA$^{AC-3'}$ (SEQ ID NO: 3999)
3'-AGAAACUACUUGAAGCUUACUUGAU$_{G_{U-5'}}$ (SEQ ID NO: 1002)

AR-3621 Target: 5'-TCTTTGATGAACTTCGAATGAACTACA-3' (SEQ ID NO: 1056)

5'-UUGAUGAACUUCGAAUGAACUACAU$^{AC-3'}$ (SEQ ID NO: 4000)
3'-AACUACUUGAAGCUUACUUGAUGUA$_{G_{U-5'}}$ (SEQ ID NO: 1003)

AR-3624 Target: 5'-TTGATGAACTTCGAATGAACTACATCA-3' (SEQ ID NO: 1057)

5'-UCGAAUGAACUACAUCAAGGAACUC$^{AC-3'}$ (SEQ ID NO: 4001)
3'-AGCUUACUUGAUGUAGUUCCUUGAG$_{C_{U-5'}}$ (SEQ ID NO: 1004)

AR-3634 Target: 5'-TCGAATGAACTACATCAAGGAACTCGA-3' (SEQ ID NO: 1058)

5'-UGCAAAAGAAAAAAUCCCACAUCCU$^{AA-3'}$ (SEQ ID NO: 4002)
3'-ACGUUUUCUUUUUUAGGGUGUAGGA$_{C_{G-5'}}$ (SEQ ID NO: 1005)

AR-3674 Target: 5'-TGCAAAAGAAAAAATCCCACATCCTGC-3' (SEQ ID NO: 1059)

5'-AAAGAAAAAAUCCCACAUCCUGCUC$^{CC-3'}$ (SEQ ID NO: 4003)
3'-UUUCUUUUUUAGGGUGUAGGACGAG$_{U-5'}$ (SEQ ID NO: 1006)

AR-3678 Target: 5'-AAAGAAAAAATCCCACATCCTGCTCAA-3' (SEQ ID NO: 1060)

5'-ACUUUUGACCUGCUAAUCAAGUCAC$^{CA-3'}$ (SEQ ID NO: 4004)
3'-UGAAAACUGGACGAUUAGUUCAGUG$_{U_{G-5'}}$ (SEQ ID NO: 1007)

AR-3773 Target: 5'-ACTTTTGACCTGCTAATCAAGTCACAC-3' (SEQ ID NO: 1061)

5'-CCAAGAUCCUUUCUGGGAAAGUCAA$^{AA-3'}$ (SEQ ID NO: 4005)
3'-GGUUCUAGGAAAGACCCUUUCAGUU$_{C_{G-5'}}$ (SEQ ID NO: 1008)

AR-3855 Target: 5'-CCAAGATCCTTTCTGGGAAAGTCAAGC-3' (SEQ ID NO: 1062)

5'-GGAAAGUCAAGCCCAUCUAUUUCCA$^{AC-3'}$ (SEQ ID NO: 4006)
3'-CCUUUCAGUUCGGGUAGAUAAAGGU$_{G_{U-5'}}$ (SEQ ID NO: 1009)

AR-3870 Target: 5'-GGAAAGTCAAGCCCATCTATTTCCACA-3' (SEQ ID NO: 1063)

5'-AGAUGUCUUCUGCCUGUUAUAACUC$^{CA-3'}$ (SEQ ID NO: 4007)
3'-UCUACAGAAGACGGACAAUAUUGAG$_{A_{C-5'}}$ (SEQ ID NO: 1010)

AR-3950 Target: 5'-AGATGTCTTCTGCCTGTTATAACTCTG-3' (SEQ ID NO: 1064)

5'-GGGAAUUUCCUCUAUUGAUGUACAG$^{CA-3'}$ (SEQ ID NO: 4008)
3'-CCCUUAAAGGAGAUAACUACAUGUC$_{A_{G-5'}}$ (SEQ ID NO: 1011)

AR-4000 Target: 5'-GGGAATTTCCTCTATTGATGTACAGTC-3' (SEQ ID NO: 1065)

5'-UUGAUGUACAGUCUGUCAUGAACAU$^{AC-3'}$ (SEQ ID NO: 4009)
3'-AACUACAUGUCAGACAGUACUUGUA$_{C_{A-5'}}$ (SEQ ID NO: 1012)

AR-4014 Target: 5'-TTGATGTACAGTCTGTCATGAACATGT-3' (SEQ ID NO: 1066)

5'-UACAGUCUGUCAUGAACAUGUUCCU$^{AC-3'}$ (SEQ ID NO: 4010)
3'-AUGUCAGACAGUACUUGUACAAGGA$_{C_{U-5'}}$ (SEQ ID NO: 1013)

AR-4020 Target: 5'-TACAGTCTGTCATGAACATGTTCCTGA-3' (SEQ ID NO: 1067)

TABLE 5-continued

Selected Human Anti-AR 27mer "Blunt/Fray" DsiRNA Agents

5'-GUCAUGAACAUGUUCCUGAAUUCUA$^{CC-3'}$ (SEQ ID NO: 4011)
3'-CAGUACUUGUACAAGGACUUAAGAU$_{A-5'}^{A}$ (SEQ ID NO: 1014)

AR-4028 Target: 5'-GTCATGAACATGTTCCTGAATTCTATT-3' (SEQ ID NO: 1068)

5'-ACAUGUUCCUGAAUUCUAUUUGCUG$^{AA-3'}$ (SEQ ID NO: 4012)
3'-UGUACAAGGACUUAAGAUAAACGAC$_{C-5'}^{C}$ (SEQ ID NO: 1015)

AR-4035 Target: 5'-ACATGTTCCTGAATTCTATTTGCTGGG-3' (SEQ ID NO: 1069)

5'-GCUGGGCUUUUUUUUCUCUUUCUC$^{CA-3'}$ (SEQ ID NO: 4013)
3'-CGACCCGAAAAAAAAAGAGAAAGAG$_{G-5'}^{A}$ (SEQ ID NO: 1016)

AR-4056 Target: 5'-GCTGGGCTTTTTTTTCTCTTTCTCTC-3' (SEQ ID NO: 1070)

5'-UUUUUUUCUCUUUCUCUCCUUUCUU$^{CC-3'}$ (SEQ ID NO: 4014)
3'-AAAAAAAGAGAAAGAGAGGAAAGAA$_{A-5'}^{A}$ (SEQ ID NO: 1017)

AR-4065 Target: 5'-TTTTTTTCTCTTTCTCTCCTTTCTTTT-3' (SEQ ID NO: 1071)

5'-GUGUUUUGAAUGGUGUUGUAUGCCU$^{CC-3'}$ (SEQ ID NO: 4015)
3'-CACAAAACUUACCACAACAUACGGA$_{A-5'}^{A}$ (SEQ ID NO: 1018)

AR-4161 Target: 5'-GTGTTTTGAATGGTGTTGTATGCCTTT-3' (SEQ ID NO: 1072)

5'-AUGGUGUUGUAUGCCUUUAAAUCUG$^{CA-3'}$ (SEQ ID NO: 4016)
3'-UACCACAACAUACGGAAAAUUUAGAC$_{C-5'}^{A}$ (SEQ ID NO: 1019)

AR-4170 Target: 5'-ATGGTGTTGTATGCCTTTAAATCTGTG-3' (SEQ ID NO: 1073)

5'-GUCAAGUUCUGCUUGUUUACAGCAC$^{CC-3'}$ (SEQ ID NO: 4017)
3'-CAGUUCAACACGAACAAAUGUCGUG$_{U-5'}^{A}$ (SEQ ID NO: 1020)

AR-4218 Target: 5'-GTCAAGTTGTGCTTGTTTACAGCACTA-3' (SEQ ID NO: 1074)

5'-AGCUAAGAUUAUCUGGGGAAAUCAA$^{CC-3'}$ (SEQ ID NO: 4018)
3'-UCGAUUCUAAUAGACCCCUUUAGUU$_{U-5'}^{U}$ (SEQ ID NO: 1021)

AR-4299 Target: 5'-AGCTAAGATTATCTGGGGAAATCAAAA-3' (SEQ ID NO: 1075)

5'-UCUGGGGAAAUCAAAACAAAACAA$^{AA-3'}$ (SEQ ID NO: 4019)
3'-AGACCCCUUUAGUUUUGUUUUUGUU$_{G-5'}^{C}$ (SEQ ID NO: 1022)

AR-4310 Target: 5'-TCTGGGGAAATCAAAACAAAACAAGC-3' (SEQ ID NO: 1076)

5'-GGGAAAUCAAAACAAAACAAGCAA$^{CA-3'}$ (SEQ ID NO: 4020)
3'-CCCUUUAGUUUUGUUUUGUUCGUU$_{G-5'}^{U}$ (SEQ ID NO: 1023)

AR-4314 Target: 5'-GGGAAATCAAAACAAAACAAGCAAAC-3' (SEQ ID NO: 1077)

5'-CGGUGAAGUUUUUAAAAGCUGCUAA$^{CA-3'}$ (SEQ ID NO: 4021)
3'-GCCACUUCAAAAAUUUUCGACGAUU$_{C-5'}^{U}$ (SEQ ID NO: 1249)

AR-249 Target: 5'-CGGTGAAGTTTTTAAAAGCTGCTAAAG-3' (SEQ ID NO: 1312)

5'-GUUUUUAAAAGCUGCUAAAGACUCG$^{AC-3'}$ (SEQ ID NO: 4022)
3'-CAAAAAUUUUCGACGAUUUCUGAGC$_{U-5'}^{C}$ (SEQ ID NO: 1250)

AR-256 Target: 5'-GTTTTTAAAAGCTGCTAAAGACTCGGA-3' (SEQ ID NO: 1313)

TABLE 5-continued

Selected Human Anti-AR 27mer "Blunt/Fray" DsiRNA Agents

5'-UUUUAAAAGCUGCUAAAGACUCGGA$^{AA-3'}$ (SEQ ID NO: 4023)
3'-AAAAUUUUCGACGAUUUCUGAGCCU$_{C-5'}$ (SEQ ID NO: 1251)

AR-258 Target: 5'-TTTTAAAAGCTGCTAAAGACTCGGAGG-3' (SEQ ID NO: 1314)

5'-GCGGAGAGAACCCUCUGUUUUCCCC$^{AC-3'}$ (SEQ ID NO: 4024)
3'-CGCCUCUCUUGGGAGACAAAAGGGG$_{GU-5'}$ (SEQ ID NO: 1252)

AR-618 Target: 5'-GCGGAGAGAACCCTCTGTTTTCCCCA-3' (SEQ ID NO: 1315)

5'-AGAGAUCAAAAGAUGAAAAGGCAGU$^{AC-3'}$ (SEQ ID NO: 4025)
3'-UCUCUAGUUUUCUACUUUUCCGUCA$_{GU-5'}$ (SEQ ID NO: 1253)

AR-691 Target: 5'-AGAGATCAAAAGATGAAAAGGCAGTCA-3' (SEQ ID NO: 1316)

5'-AUCAAAAGAUGAAAAGGCAGUCAGG$^{CA-3'}$ (SEQ ID NO: 4026)
3'-UAGUUUUCUACUUUUCCGUCAGUCC$_{AG-5'}$ (SEQ ID NO: 1254)

AR-695 Target: 5'-ATCAAAAGATGAAAAGGCAGTCAGGTC-3' (SEQ ID NO: 1317)

5'-UUCAGUAGCCAAAAAACAAACAAA$^{AC-3'}$ (SEQ ID NO: 4027)
3'-AAGUCAUCGGUUUUUUGUUUUGUUU$_{GU-5'}$ (SEQ ID NO: 1255)

AR-722 Target: 5'-TTCAGTAGCCAAAAAACAAACAAACA-3' (SEQ ID NO: 1318)

5'-AAAAAACAAACAAACAAAAACAAA$^{CC-3'}$ (SEQ ID NO: 4028)
3'-UUUUUUGUUUUGUUUGUUUUUGUUU$_{U-5'}$ (SEQ ID NO: 1256)

AR-732 Target: 5'-AAAAAACAAACAAACAAAAACAAAAA-3' (SEQ ID NO: 1319)

5'-AAUAAAAGAAAAAGAUAAUAACUCA$^{AC-3'}$ (SEQ ID NO: 4029)
3'-UUAUUUUCUUUUUCUAUUAUUGAGU$_{CA-5'}$ (SEQ ID NO: 1257)

AR-765 Target: 5'-AATAAAAGAAAAGATAATAACTCAGT-3' (SEQ ID NO: 1320)

5'-UAAAAGAAAAAGAUAAUAACUCAGU$^{CA-3'}$ (SEQ ID NO: 4030)
3'-AUUUUCUUUUUCUAUUAUUGAGUCA$_{AG-5'}$ (SEQ ID NO: 1258)

AR-767 Target: 5'-TAAAAGAAAAGATAATAACTCAGTTC-3' (SEQ ID NO: 1321)

5'-GAAAAAGAUAAUAACUCAGUUCUUA$^{CC-3'}$ (SEQ ID NO: 4031)
3'-CUUUUUCUAUUAUUGAGUCAAGAAU$_{A-5'}$ (SEQ ID NO: 1259)

AR-772 Target: 5'-GAAAAGATAATAACTCAGTTCTTATT-3' (SEQ ID NO: 1322)

5'-UAAUAACUCAGUUCUUAUUUGCACC$^{CC-3'}$ (SEQ ID NO: 4032)
3'-AUUAUUGAGUCAAGAAUAAACGUGG$_{AU-5'}$ (SEQ ID NO: 1260)

AR-780 Target: 5'-TAATAACTCAGTTCTTATTTGCACCTA-3' (SEQ ID NO: 1323)

5'-CUCAGUUCUUAUUUGCACCUACUUC$^{CA-3'}$ (SEQ ID NO: 4033)
3'-GAGUCAAGAAUAAACGUGGAUGAAG$_{UC-5'}$ (SEQ ID NO: 1261)

AR-786 Target: 5'-CTCAGTTCTTATTTGCACCTACTTCAG-3' (SEQ ID NO: 1324)

5'-GGUGGAGGAUUUUGUUUUUUUCUUU$^{CC-3'}$ (SEQ ID NO: 4034)
3'-CCACCUCCUAAAACAAAAAAGAAA$_{AU-5'}$ (SEQ ID NO: 1262)

AR-831 Target: 5'-GGTGGAGGATTTTGTTTTTTCTTTTA-3' (SEQ ID NO: 1325)

TABLE 5-continued

Selected Human Anti-AR 27mer "Blunt/Fray" DsiRNA Agents

5'-UUUGUUUUUUCUUUUAAGAUCUGG$^{AA\text{-}3'}$ (SEQ ID NO: 4035)
3'-AAACAAAAAAAGAAAAUUCUAGACC$_{CG\text{-}5'}$ (SEQ ID NO: 1263)

AR-841 Target: 5'-TTTGTTTTTTCTTTTAAGATCTGGGC-3' (SEQ ID NO: 1326)

5'-UUUUUUCUUUUAAGAUCUGGGCAUC$^{CC\text{-}3'}$ (SEQ ID NO: 4036)
3'-AAAAAAGAAAAUUCUAGACCCGUAG$_{AA\text{-}5'}$ (SEQ ID NO: 1264)

AR-846 Target: 5'-TTTTTTCTTTTAAGATCTGGGCATCTT-3' (SEQ ID NO: 1327)

5'-UCUGGGCAUCUUUUGAAUCUACCCU$^{CA\text{-}3'}$ (SEQ ID NO: 4037)
3'-AGACCCGUAGAAAACUUAGAUGGGA$_{AG\text{-}5'}$ (SEQ ID NO: 1265)

AR-861 Target: 5'-TCTGGGCATCTTTTGAATCTACCCTTC-3' (SEQ ID NO: 1328)

5'-CGCAAGUUUCCUUCUCUGGAGCUUC$^{AA\text{-}3'}$ (SEQ ID NO: 4038)
3'-GCGUUCAAAGGAAGAGACCUCGAAG$_{GG\text{-}5'}$ (SEQ ID NO: 1266)

AR-997 Target: 5'-CGCAAGTTTCCTTCTCTGGAGCTTCCC-3' (SEQ ID NO: 1329)

5'-AAGGGAAGUAGGUGGAAGAUUCAGC$^{AC\text{-}3'}$ (SEQ ID NO: 4039)
3'-UUCCCUUCAUCCACCUUCUAAGUCG$_{GU\text{-}5'}$ (SEQ ID NO: 1267)

AR-1106 Target: 5'-AAGGGAAGTAGGTGGAAGATTCAGCCA-3' (SEQ ID NO: 1330)

5'-GGAAGUAGGUGGAAGAUUCAGCCAA$^{AA\text{-}3'}$ (SEQ ID NO: 4040)
3'-CCUUCAUCCACCUUCUAAGUCGGUU$_{CG\text{-}5'}$ (SEQ ID NO: 1268)

AR-1109 Target: 5'-GGAAGTAGGTGGAAGATTCAGCCAAGC-3' (SEQ ID NO: 1331)

5'-CAAGGACAAUUACUUAGGGGGCACU$^{CA\text{-}3'}$ (SEQ ID NO: 4041)
3'-GUUCCUGUUAAUGAAUCCCCCGUGA$_{AG\text{-}5'}$ (SEQ ID NO: 1269)

AR-1804 Target: 5'-CAAGGACAATTACTTAGGGGGCACTTC-3' (SEQ ID NO: 1332)

5'-GCCGAAUGCAAAGGUUCUCUGCUAG$^{CA\text{-}3'}$ (SEQ ID NO: 4042)
3'-CGGCUUACGUUUCCAAGAGACGAUC$_{UG\text{-}5'}$ (SEQ ID NO: 1270)

AR-2003 Target: 5'-GCCGAATGCAAAGGTTCTCTGCTAGAC-3' (SEQ ID NO: 1333)

5'-GCAAGAGCACUGAAGAUACUGCUGA$^{AC\text{-}3'}$ (SEQ ID NO: 4043)
3'-CGUUCUCGUGACUUCUAUGACGACU$_{CA\text{-}5'}$ (SEQ ID NO: 1271)

AR-2040 Target: 5'-GCAAGAGCACTGAAGATACTGCTGAGT-3' (SEQ ID NO: 1334)

5'-CUGAAGAUACUGCUGAGUAUUCCCC$^{CC\text{-}3'}$ (SEQ ID NO: 4044)
3'-GACUUCUAUGACGACUCAUAAGGGG$_{AA\text{-}5'}$ (SEQ ID NO: 1272)

AR-2049 Target: 5'-CTGAAGATACTGCTGAGTATTCCCCTT-3' (SEQ ID NO: 1335)

5'-UUGUGUCAAAAGCGAAAUGGGCCCC$^{CA\text{-}3'}$ (SEQ ID NO: 4045)
3'-AACACAGUUUUCGCUUUACCCGGGG$_{AC\text{-}5'}$ (SEQ ID NO: 1273)

AR-2695 Target: 5'-TTGTGTCAAAAGCGAAATGGGCCCCTG-3' (SEQ ID NO: 1336)

5'-UGUUUUGCCCAUUGACUAUUACUUU$^{AA\text{-}3'}$ (SEQ ID NO: 4046)
3'-ACAAAACGGGUAACUGAUAAUGAAA$_{GG\text{-}5'}$ (SEQ ID NO: 1274)

AR-2779 Target: 5'-TGTTTTGCCCATTGACTATTACTTTCC-3' (SEQ ID NO: 1337)

TABLE 5-continued

Selected Human Anti-AR 27mer "Blunt/Fray" DsiRNA Agents

5'-CCCAUUGACUAUUACUUUCCACCCC$^{cA-3'}$ (SEQ ID NO: 4047)
3'-GGGUAACUGAUAAUGAAAGGUGGGG$_{U\text{-}C\text{-}5'}$ (SEQ ID NO: 1275)

AR-2786 Target: 5'-CCCATTGACTATTACTTTCCACCCCAG-3' (SEQ ID NO: 1338)

5'-GCAAGGUCUUCUUCAAAAGAGCCGC$^{cA-3'}$ (SEQ ID NO: 4048)
3'-CGUUCCAGAAGAAGUUUUCUCGGCG$_{A\text{-}C\text{-}5'}$ (SEQ ID NO: 1276)

AR-2880 Target: 5'-GCAAGGTCTTCTTCAAAAGAGCCGCTG-3' (SEQ ID NO: 1339)

5'-UGAUUGCACUAUUGAUAAAUUCCGA$^{cA-3'}$ (SEQ ID NO: 4049)
3'-ACUAACGUGAUAACUAUUUAAGGCU$_{U\text{-}C\text{-}5'}$ (SEQ ID NO: 1277)

AR-2941 Target: 5'-TGATTGCACTATTGATAAATTCCGAAG-3' (SEQ ID NO: 1340)

5'-UCCGAAGGAAAAAUUGUCCAUCUUG$^{cA-3'}$ (SEQ ID NO: 4050)
3'-AGGCUUCCUUUUUAACAGGUAGAAC$_{A\text{-}G\text{-}5'}$ (SEQ ID NO: 1278)

AR-2961 Target: 5'-TCCGAAGGAAAAATTGTCCATCTTGTC-3' (SEQ ID NO: 1341)

5'-AGGAAAAAUUGUCCAUCUUGUCGUC$^{cC-3'}$ (SEQ ID NO: 4051)
3'-UCCUUUUUAACAGGUAGAACAGCAG$_{A\text{-}5'}$ (SEQ ID NO: 1279)

AR-2966 Target: 5'-AGGAAAAATTGTCCATCTTGTCGTCTT-3' (SEQ ID NO: 1342)

5'-GACAGUGUCACACAUUGAAGGCUAU$^{AC-3'}$ (SEQ ID NO: 4052)
3'-CUGUCACAGUGUGUAACUUCCGAUA$_{C\text{-}U\text{-}5'}$ (SEQ ID NO: 1280)

AR-3121 Target: 5'-GACAGTGTCACACATTGAAGGCTATGA-3' (SEQ ID NO: 1343)

5'-AUUGAAGGCUAUGAAUGUCAGCCCA$^{cA-3'}$ (SEQ ID NO: 4053)
3'-UAACUUCCGAUACUUACAGUCGGGU$_{A\text{-}G\text{-}5'}$ (SEQ ID NO: 1281)

AR-3134 Target: 5'-ATTGAAGGCTATGAATGTCAGCCCATC-3' (SEQ ID NO: 1344)

5'-AGAUGGCUGUCAUUCAGUACUCCUG$^{AC-3'}$ (SEQ ID NO: 4054)
3'-UCUACCGACAGUAAGUCAUGAGGAC$_{C\text{-}U\text{-}5'}$ (SEQ ID NO: 1282)

AR-3342 Target: 5'-AGATGGCTGTCATTCAGTACTCCTGGA-3' (SEQ ID NO: 1345)

5'-UCUGGUUUUCAAUGAGUACCGCAUG$^{AC-3'}$ (SEQ ID NO: 4055)
3'-AGACCAAAAGUUACUCAUGGCGUAC$_{G\text{-}U\text{-}5'}$ (SEQ ID NO: 1283)

AR-3445 Target: 5'-TCTGGTTTTCAATGAGTACCGCATGCA-3' (SEQ ID NO: 1346)

5'-AGGAAUUCCUGUGCAUGAAAGCACU$^{AA-3'}$ (SEQ ID NO: 4056)
3'-UCCUUAAGGACACGUACUUUCGUGA$_{C\text{-}G\text{-}5'}$ (SEQ ID NO: 1284)

AR-3549 Target: 5'-AGGAATTCCTGTGCATGAAAGCACTGC-3' (SEQ ID NO: 1347)

5'-CAAAAAUUCUUUGAUGAACUUCGAA$^{cA-3'}$ (SEQ ID NO: 4057)
3'-GUUUUUAAGAAACUACUUGAAGCUU$_{A\text{-}C\text{-}5'}$ (SEQ ID NO: 1285)

AR-3614 Target: 5'-CAAAAATTCTTTGATGAACTTCGAATG-3' (SEQ ID NO: 1348)

5'-CUUUGAUGAACUUCGAAUGAACUAC$^{cC-3'}$ (SEQ ID NO: 4058)
3'-GAAACUACUUGAAGCUUACUUGAUG$_{U\text{-}A\text{-}5'}$ (SEQ ID NO: 1286)

AR-3622 Target: 5'-CTTTGATGAACTTCGAATGAACTACAT-3' (SEQ ID NO: 1349)

TABLE 5-continued

Selected Human Anti-AR 27mer "Blunt/Fray" DsiRNA Agents

5'-UGAUGAACUUCGAAUGAACUACAUC$^{CC\text{-}3'}$ (SEQ ID NO: 4059)
3'-ACUACUUGAAGCUUACUUGAUGUAG$_{U\text{-}5'}$ (SEQ ID NO: 1287)

AR-3625 Target: 5'-TGATGAACTTCGAATGAACTACATCAA-3' (SEQ ID NO: 1350)

5'-CGAAUGAACUACAUCAAGGAACUCG$^{CC\text{-}3'}$ (SEQ ID NO: 4060)
3'-GCUUACUUGAUGUAGUUCCUUGAGC$_{U_{A\text{-}5'}}$ (SEQ ID NO: 1288)

AR-3635 Target: 5'-CGAATGAACTACATCAAGGAACTCGAT-3' (SEQ ID NO: 1351)

5'-AAUGAACUACAUCAAGGAACUCGAU$^{AA\text{-}3'}$ (SEQ ID NO: 4061)
3'-UUACUUGAUGUAGUUCCUUGAGCUA$_{G\text{-}5'}$ (SEQ ID NO: 1289)

AR-3637 Target: 5'-AATGAACTACATCAAGGAACTCGATCG-3' (SEQ ID NO: 1352)

5'-GCAAAAGAAAAAAUCCCACAUCCUG$^{AC\text{-}3'}$ (SEQ ID NO: 4062)
3'-CGUUUUCUUUUUUAGGGUGUAGGAC$_{G_{A\text{-}5'}}$ (SEQ ID NO: 1290)

AR-3675 Target: 5'-GCAAAAGAAAAAATCCCACATCCTGCT-3' (SEQ ID NO: 1353)

5'-AAGAAAAAAUCCCACAUCCUGCUCA$^{CA\text{-}3'}$ (SEQ ID NO: 4063)
3'-UUCUUUUUUAGGGUGUAGGACGAGU$_{U_{C\text{-}5'}}$ (SEQ ID NO: 1291)

AR-3679 Target: 5'-AAGAAAAAATCCCACATCCTGCTCAAG-3' (SEQ ID NO: 1354)

5'-CUUUUGACCUGCUAAUCAAGUCACA$^{AC\text{-}3'}$ (SEQ ID NO: 4064)
3'-GAAAACUGGACGAUUAGUUCAGUGU$_{G_{U\text{-}5'}}$ (SEQ ID NO: 1292)

AR-3774 Target: 5'-CTTTTGACCTGCTAATCAAGTCACACA-3' (SEQ ID NO: 1355)

5'-GCCUGUUAUAACUCUGCACUACUCC$^{CA\text{-}3'}$ (SEQ ID NO: 4065)
3'-CGGACAAUAUUGAGACGUGAUGAGG$_{A_{G\text{-}5'}}$ (SEQ ID NO: 1293)

AR-3961 Target: 5'-GCCTGTTATAACTCTGCACTACTCCTC-3' (SEQ ID NO: 1356)

5'-CUGUUAUAACUCUGCACUACUCCUC$^{CA\text{-}3'}$ (SEQ ID NO: 4066)
3'-GACAAUAUUGAGACGUGAUGAGGAG$_{A_{C\text{-}5'}}$ (SEQ ID NO: 1294)

AR-3963 Target: 5'-CTGTTATAACTCTGCACTACTCCTCTG-3' (SEQ ID NO: 1357)

5'-GGAAUUUCCUCUAUUGAUGUACAGU$^{AC\text{-}3'}$ (SEQ ID NO: 4067)
3'-CCUUAAAGGAGAUAACUACAUGUCA$_{G_{A\text{-}5'}}$ (SEQ ID NO: 1295)

AR-4001 Target: 5'-GGAATTTCCTCTATTGATGTACAGTCT-3' (SEQ ID NO: 1358)

5'-CUCUAUUGAUGUACAGUCUGUCAUG$^{CC\text{-}3'}$ (SEQ ID NO: 4068)
3'-GAGAUAACUACAUGUCAGACAGUAC$_{U\text{-}5'}$ (SEQ ID NO: 1296)

AR-4009 Target: 5'-CTCTATTGATGTACAGTCTGTCATGAA-3' (SEQ ID NO: 1359)

5'-UCAUGAACAUGUUCCUGAAUUCUAU$^{CC\text{-}3'}$ (SEQ ID NO: 4069)
3'-AGUACUUGUACAAGGACUUAAGAUA$_{A_{A\text{-}5'}}$ (SEQ ID NO: 1297)

AR-4029 Target: 5'-TCATGAACATGTTCCTGAATTCTATTT-3' (SEQ ID NO: 1360)

5'-UCCUGAAUUCUAUUUGCUGGGCUUU$^{CC\text{-}3'}$ (SEQ ID NO: 4070)
3'-AGGACUUAAGAUAAACGACCCGAAA$_{A_{A\text{-}5'}}$ (SEQ ID NO: 1298)

AR-4041 Target: 5'-TCCTGAATTCTATTTGCTGGGCTTTT-3' (SEQ ID NO: 1361)

TABLE 5-continued

Selected Human Anti-AR 27mer "Blunt/Fray" DsiRNA Agents

5'-GCUUUUUUUUCUCUUUCUCUCCUU$^{CA-3'}$ (SEQ ID NO: 4071)
3'-CGAAAAAAAAAGAGAAAGAGAGGAA$_{AG-5'}$ (SEQ ID NO: 1299)

AR-4061 Target: 5'-GCTTTTTTTTCTCTTTCTCTCCTTTC-3' (SEQ ID NO: 1362)

5'-UUUUUUCUCUUUCUCUCCUUUCUUU$^{CC-3'}$ (SEQ ID NO: 4072)
3'-AAAAAAGAGAAAGAGAGGAAAGAAA$_{AA-5'}$ (SEQ ID NO: 1300)

AR-4066 Target: 5'-TTTTTTCTCTTTCTCTCCTTTCTTTTT-3' (SEQ ID NO: 1363)

5'-CUCUUUCUCUCCUUUCUUUUUCUUC$^{CC-3'}$ (SEQ ID NO: 4073)
3'-GAGAAAGAGAGGAAAGAAAAAGAAG$_{AA-5'}$ (SEQ ID NO: 1301)

AR-4072 Target: 5'-CTCTTTCTCTCCTTTCTTTTTCTTCTT-3' (SEQ ID NO: 1364)

5'-CCAUGGCACCUUCAGACUUUGCUUC$^{AA-3'}$ (SEQ ID NO: 4074)
3'-GGUACCGUGGAAGUCUGAAACGAAG$_{GG-5'}$ (SEQ ID NO: 1302)

AR-4118 Target: 5'-CCATGGCACCTTCAGACTTTGCTTCCC-3' ( SEQ ID NO: 1365)

5'-UGUUUUGAAUGGUGUUGUAUGCCUU$^{CC-3'}$ (SEQ ID NO: 4075)
3'-ACAAAACUUACCACAACAUACGGAA$_{AU-5'}$ (SEQ ID NO: 1303)

AR-4162 Target: 5'-TGTTTTGAATGGTGTTGTATGCCTTTA-3' (SEQ ID NO: 1366)

5'-UGGUGUUGUAUGCCUUUAAAUCUGU$^{AC-3'}$ (SEQ ID NO: 4076)
3'-ACCACAACAUACGGAAAUUUAGACA$_{CU-5'}$ (SEQ ID NO: 1304)

AR-4171 Target: 5'-TGGTGTTGTATGCCTTTAAATCTGTGA-3' (SEQ ID NO: 1367)

5'-CUUUAAAUCUGUGAUGAUCCUCAUA$^{CA-3'}$ (SEQ ID NO: 4077)
3'-GAAAUUUAGACACUACUAGGAGUAU$_{AC-5'}$ (SEQ ID NO: 1305)

AR-4184 Target: 5'-CTTTAAATCTGTGATGATCCTCATATG-3' (SEQ ID NO: 1368)

5'-UCUGUGAUGAUCCUCAUAUGGCCCA$^{AC-3'}$ (SEQ ID NO: 4078)
3'-AGACACUACUAGGAGUAUACCGGGU$_{CA-5'}$ (SEQ ID NO: 1306)

AR-4191 Target: 5'-TCTGTGATGATCCTCATATGGCCCAGT-3' (SEQ ID NO: 1369)

5'-AAGUUGUGCUUGUUUACAGCACUAC$^{CA-3'}$ (SEQ ID NO: 4079)
3'-UUCAACACGAACAAAUGUCGUGAUG$_{AG-5'}$ (SEQ ID NO: 1307)

AR-4221 Target: 5'-AAGTTGTGCTTGTTTACAGCACTACTC-3' (SEQ ID NO: 1370)

5'-ACGUUUACUUAUCUUAUGCCACGGG$^{CC-3'}$ (SEQ ID NO: 4080)
3'-UGCAAAUGAAUAGAAUACGGUGCCC$_{UU-5'}$ (SEQ ID NO: 1308)

AR-4264 Target: 5'-ACGTTTACTTATCTTATGCCACGGGAA-3' (SEQ ID NO: 1371)

5'-AGUUUAGAGAGCUAAGAUUAUCUGG$^{AA-3'}$ (SEQ ID NO: 4081)
3'-UCAAAUCUCUCGAUUCUAAUAGACC$_{CC-5'}$ (SEQ ID NO: 1309)

AR-4290 Target: 5'-AGTTTAGAGAGCTAAGATTATCTGGGG-3' (SEQ ID NO: 1372)

5'-GCUAAGAUUAUCUGGGGAAAUCAAA$^{CA-3'}$ (SEQ ID NO: 4082)
3'-CGAUUCUAAUAGACCCCUUUAGUUU$_{UG-5'}$ (SEQ ID NO: 1310)

AR-4300 Target: 5'-GCTAAGATTATCTGGGGAAATCAAAC-3' (SEQ ID NO: 1373)

TABLE 5-continued

Selected Human Anti-AR 27mer "Blunt/Fray" DsiRNA Agents

```
5'-CUGGGGAAAUCAAAACAAAAACAAG^(AC-3')    (SEQ ID NO: 4083)
3'-GACCCCUUUAGUUUUGUUUUUGUUC_(GU-5')    (SEQ ID NO: 1311)
```

AR-4311 Target: 5'-CTGGGGAAATCAAAACAAAAACAAGCA-3' (SEQ ID NO: 1374)

```
5'-GAGCCAGCUUGCUGGGAGAGCGGGA^(AA-3')    (SEQ ID NO: 4084)
3'-CUCGGUCGAACGACCCUCUCGCCCU_(GC-5')    (SEQ ID NO: 1906)
```

AR-39 Target: 5'-GAGCCAGCTTGCTGGGAGAGCGGGACG-3' (SEQ ID NO: 2311)

```
5'-CGGCUCCAGCGACAGCCAACGCCUC^(CC-3')    (SEQ ID NO: 4085)
3'-GCCGAGGUCGCUGUCGGUUGCGGAG_(AA-5')    (SEQ ID NO: 1907)
```

AR-174 Target: 5'-CGGCTCCAGCGACAGCCAACGCCTCTT-3' (SEQ ID NO: 2312)

```
5'-CAGCCAACGCCUCUUGCAGCGCGGC^(AA-3')    (SEQ ID NO: 4086)
3'-GUCGGUUGCGGAGAACGUCGCGCCG_(CC-5')    (SEQ ID NO: 1908)
```

AR-186 Target: 5'-CAGCCAACGCCTCTTGCAGCGCGGCGG-3' (SEQ ID NO: 2313)

```
5'-GCCUCUUGCAGCGCGGCGGCUUCGA^(CA-3')    (SEQ ID NO: 4087)
3'-CGGAGAACGUCGCGCCGCCGAAGCU_(UC-5')    (SEQ ID NO: 1909)
```

AR-194 Target: 5'-GCCTCTTGCAGCGCGGCGGCTTCGAAG-3' (SEQ ID NO: 2314)

```
5'-UGCAGCGCGGCGGCUUCGAAGCCGC^(AA-3')    (SEQ ID NO: 4088)
3'-ACGUCGCCGCCGAAGCUUCGGCG_(GC-5')     (SEQ ID NO: 1910)
```

AR-200 Target: 5'-TGCAGCGCGGCGGCTTCGAAGCCGCCG-3' (SEQ ID NO: 2315)

```
5'-CGAAGCCGCCGCCCGGAGCUGCCCU^(CC-3')    (SEQ ID NO: 4089)
3'-GCUUCGGCGGCGGGCCUCGACGGGA_(AA-5')    (SEQ ID NO: 1911)
```

AR-216 Target: 5'-CGAAGCCGCCGCCCGGAGCTGCCCTTT-3' (SEQ ID NO: 2316)

```
5'-CGCCGCCCGGAGCUGCCCUUUCCUC^(CC-3')    (SEQ ID NO: 4090)
3'-GCGGCGGGCCUCGACGGGAAAGGAG_(AA-5')    (SEQ ID NO: 1912)
```

AR-222 Target: 5'-CGCCGCCCGGAGCTGCCCTTTCCTCTT-3' (SEQ ID NO: 2317)

```
5'-UGAAGUUUUUAAAAGCUGCUAAAGA^(AC-3')    (SEQ ID NO: 4091)
3'-ACUUCAAAAAUUUUCGACGAUUUCU_(GA-5')    (SEQ ID NO: 1913)
```

AR-252 Target: 5'-TGAAGTTTTTAAAAGCTGCTAAAGACT-3' (SEQ ID NO: 2318)

```
5'-CCGUCUUCUCUCCCGCAGCUGCCUC^(CA-3')    (SEQ ID NO: 4092)
3'-GGCAGAAGAGAGGGCGUCGACGGAG_(UC-5')    (SEQ ID NO: 1914)
```

AR-375 Target: 5'-CCGTCTTCTCTCCCGCAGCTGCCTCAG-3' (SEQ ID NO: 2319)

```
5'-CCGCAGCUGCCUCAGUCGGCUACUC^(CA-3')    (SEQ ID NO: 4093)
3'-GGCGUCGACGGAGUCAGCCGAUGAG_(AG-5')    (SEQ ID NO: 1915)
```

AR-387 Target: 5'-CCGCAGCTGCCTCAGTCGGCTACTCTC-3' (SEQ ID NO: 2320)

```
5'-UUUGGCUGCGAGCGGGCGAGCUAGC^(CA-3')    (SEQ ID NO: 4094)
3'-AAACCGACGCUCGCCCGCUCGAUCG_(AC-5')    (SEQ ID NO: 1916)
```

AR-506 Target: 5'-TTTGGCTGCGAGCGGGCGAGCTAGCTG-3' (SEQ ID NO: 2321)

TABLE 5-continued

Selected Human Anti-AR 27mer "Blunt/Fray" DsiRNA Agents

5'-CGGGCGAGCUAGCUGCACAUUGCAA$^{\text{CA-3'}}$ (SEQ ID NO: 4095)
3'-GCCCGCUCGAUCGACGUGUAACGUU$_{\text{UC-5'}}$ (SEQ ID NO: 1917)

AR-518 Target: 5'-CGGGCGAGCTAGCTGCACATTGCAAAG-3' (SEQ ID NO: 2322)

5'-UCUCUCUCCACCUCCUCCUGCCUUC$^{\text{AA-3'}}$ (SEQ ID NO: 4096)
3'-AGAGAGAGGUGGAGGAGGACGGAAG$_{\text{GG-5'}}$ (SEQ ID NO: 1918)

AR-646 Target: 5'-TCTCTCTCCACCTCCTCCTGCCTTCCC-3' (SEQ ID NO: 2323)

5'-CCAGAGAUCAAAAGAUGAAAAGGCA$^{\text{AC-3'}}$ (SEQ ID NO: 4097)
3'-GGUCUCUAGUUUUCUACUUUUCCGU$_{\text{CA-5'}}$ (SEQ ID NO: 1919)

AR-689 Target: 5'-CCAGAGATCAAAAGATGAAAAGGCAGT-3' (SEQ ID NO: 2324)

5'-CAGUAGCCAAAAAACAAAACAAACA$^{\text{CC-3'}}$ (SEQ ID NO: 4098)
3'-GUCAUCGGUUUUUUGUUUUGUUUGU$_{\text{UU-5'}}$ (SEQ ID NO: 1920)

AR-724 Target: 5'-CAGTAGCCAAAAAACAAAACAAACAAA-3' (SEQ ID NO: 2325)

5'-CCAAAAAACAAAACAAACAAAAACA$^{\text{CC-3'}}$ (SEQ ID NO: 4099)
3'-GGUUUUUUGUUUUGUUUGUUUUUGU$_{\text{UU-5'}}$ (SEQ ID NO: 1921)

AR-730 Target: 5'-CCAAAAAACAAAACAAACAAAAACAAA-3' (SEQ ID NO: 2326)

5'-ACAAAACAAACAAAAACAAAAAAGC$^{\text{AA-3'}}$ (SEQ ID NO: 4100)
3'-UGUUUUGUUUGUUUUUGUUUUUUCG$_{\text{GC-5'}}$ (SEQ ID NO: 1922)

AR-737 Target: 5'-ACAAAACAAACAAAAACAAAAAAGCCG-3' (SEQ ID NO: 2327)

5'-ACAAAAAAGCCGAAAUAAAAGAAAA$^{\text{CA-3'}}$ (SEQ ID NO: 4101)
3'-UGUUUUUUCGGCUUUAUUUUCUUUU$_{\text{UC-5'}}$ (SEQ ID NO: 1923)

AR-752 Target: 5'-ACAAAAAAGCCGAAATAAAAGAAAAAG-3' (SEQ ID NO: 2328)

5'-GCCGAAAUAAAAGAAAAAGAUAAUA$^{\text{CA-3'}}$ (SEQ ID NO: 4102)
3'-CGGCUUUAUUUUCUUUUUCUAUUAU$_{\text{UG-5'}}$ (SEQ ID NO: 1924)

AR-760 Target: 5'-GCCGAAATAAAAGAAAAAGATAATAAC-3' (SEQ ID NO: 2329)

5'-AAGAAAAAGAUAAUAACUCAGUUCU$^{\text{CC-3'}}$ (SEQ ID NO: 4103)
3'-UUCUUUUUCUAUUAUUGAGUCAAGA$_{\text{AU-5'}}$ (SEQ ID NO: 1925)

AR-770 Target: 5'-AAGAAAAAGATAATAACTCAGTTCTTA-3' (SEQ ID NO: 2330)

5'-AAAGAUAAUAACUCAGUUCUUAUUU$^{\text{AA-3'}}$ (SEQ ID NO: 4104)
3'-UUUCUAUUAUUGAGUCAAGAAUAAA$_{\text{CG-5'}}$ (SEQ ID NO: 1926)

AR-775 Target: 5'-AAAGATAATAACTCAGTTCTTATTTGC-3' (SEQ ID NO: 2331)

5'-GAUAAUAACUCAGUUCUUAUUUGCA$^{\text{AA-3'}}$ (SEQ ID NO: 4105)
3'-CUAUUAUUGAGUCAAGAAUAAACGU$_{\text{GG-5'}}$ (SEQ ID NO: 1927)

AR-778 Target: 5'-GATAATAACTCAGTTCTTATTTGCACC-3' (SEQ ID NO: 2332)

5'-UGGAGGAUUUUGUUUUUUCUUUUA$^{\text{CA-3'}}$ (SEQ ID NO: 4106)
3'-ACCUCCUAAAACAAAAAAGAAAAU$_{\text{UC-5'}}$ (SEQ ID NO: 1928)

AR-833 Target: 5'-TGGAGGATTTTGTTTTTTCTTTTAAG-3' (SEQ ID NO: 2333)

TABLE 5-continued

Selected Human Anti-AR 27mer "Blunt/Fray" DsiRNA Agents

5'-GAUUUGUUUUUUCUUUUAAGAUC$^{\text{cA-3'}}$ (SEQ ID NO: 4107)
3'-CUAAAACAAAAAAGAAAAUUCUAG$_{\text{A}_{\text{C-5'}}}$ (SEQ ID NO: 1929)

AR-838 Target: 5'-GATTTGTTTTTTCTTTTAAGATCTG-3' (SEQ ID NO: 2334)

5'-GUUUUUUCUUUUAAGAUCUGGGCA$^{\text{cA-3'}}$ (SEQ ID NO: 4108)
3'-CAAAAAAGAAAAUUCUAGACCCGU$_{\text{A}_{\text{G-5'}}}$ (SEQ ID NO: 1930)

AR-844 Target: 5'-GTTTTTTTCTTTTAAGATCTGGGCATC-3' (SEQ ID NO: 2335)

5'-GGGCAUCUUUUGAAUCUACCCUUCA$^{\text{cA-3'}}$ (SEQ ID NO: 4109)
3'-CCCGUAGAAAACUUAGAUGGGAAGU$_{\text{U}_{\text{C-5'}}}$ (SEQ ID NO: 1931)

AR-864 Target: 5'-GGGCATCTTTTGAATCTACCCTTCAAG-3' (SEQ ID NO: 2336)

5'-CAGAGCGCUUUUUGCGUGGUUGCUC$^{\text{aA-3'}}$ (SEQ ID NO: 4110)
3'-GUCUCGCGAAAAACGCACCAACGAG$_{\text{G}_{\text{G-5'}}}$ (SEQ ID NO: 1932)

AR-971 Target: 5'-CAGAGCGCTTTTTGCGTGGTTGCTCCC-3' (SEQ ID NO: 2337)

5'-CGCUUUUUGCGUGGUUGCUCCCGCA$^{\text{cA-3'}}$ (SEQ ID NO: 4111)
3'-GCGAAAAACGCACCAACGAGGGCGU$_{\text{U}_{\text{C-5'}}}$ (SEQ ID NO: 1933)

AR-976 Target: 5'-CGCTTTTTGCGTGGTTGCTCCCGCAAG-3' (SEQ ID NO: 2338)

5'-AAGUUUCCUUCUCUGGAGCUUCCCG$^{\text{aC-3'}}$ (SEQ ID NO: 4112)
3'-UUCAAAGGAAGAGACCUCGAAGGGC$_{\text{G}_{\text{U-5'}}}$ (SEQ ID NO: 1934)

AR-1000 Target: 5'-AAGTTTCCTTCTCTGGAGCTTCCCGCA-3' (SEQ ID NO: 2339)

5'-AGCUUCCCGCAGGUGGGCAGCUAGC$^{\text{cA-3'}}$ (SEQ ID NO: 4113)
3'-UCGAAGGGCGUCCACCCGUCGAUCG$_{\text{A}_{\text{C-5'}}}$ (SEQ ID NO: 1935)

AR-1016 Target: 5'-AGCTTCCCGCAGGTGGGCAGCTAGCTG-3' (SEQ ID NO: 2340)

5'-GUGGGCAGCUAGCUGCAGCGACUAC$^{\text{aA-3'}}$ (SEQ ID NO: 4114)
3'-CACCCGUCGAUCGACGUCGCUGAUG$_{\text{G}_{\text{C-5'}}}$ (SEQ ID NO: 1936)

AR-1028 Target: 5'-GTGGGCAGCTAGCTGCAGCGACTACCG-3' (SEQ ID NO: 2341)

5'-AAGUGCAGUUAGGGCUGGGAAGGGU$^{\text{aC-3'}}$ (SEQ ID NO: 4115)
3'-UUCACGUCAAUCCCGACCCUUCCCA$_{\text{G}_{\text{A-5'}}}$ (SEQ ID NO: 1937)

AR-1146 Target: 5'-AAGTGCAGTTAGGGCTGGGAAGGGTCT-3' (SEQ ID NO: 2342)

5'-AGUGCAGUUAGGGCUGGGAAGGGUC$^{\text{cC-3'}}$ (SEQ ID NO: 4116)
3'-UCACGUCAAUCCCGACCCUUCCCAG$_{\text{A}_{\text{U-5'}}}$ (SEQ ID NO: 1938)

AR-1147 Target: 5'-AGTGCAGTTAGGGCTGGGAAGGGTCTA-3' (SEQ ID NO: 2343)

5'-GUGCAGUUAGGGCUGGGAAGGGUCU$^{\text{cA-3'}}$ (SEQ ID NO: 4117)
3'-CACGUCAAUCCCGACCCUUCCCAGA$_{\text{U}_{\text{G-5'}}}$ (SEQ ID NO: 1939)

AR-1148 Target: 5'-GTGCAGTTAGGGCTGGGAAGGGTCTAC-3' (SEQ ID NO: 2344)

5'-UGCAGUUAGGGCUGGGAAGGGUCUA$^{\text{aA-3'}}$ (SEQ ID NO: 4118)
3'-ACGUCAAUCCCGACCCUUCCCAGAU$_{\text{G}_{\text{G-5'}}}$ (SEQ ID NO: 1940)

AR-1149 Target: 5'-TGCAGTTAGGGCTGGGAAGGGTCTACC-3' (SEQ ID NO: 2345)

TABLE 5-continued

Selected Human Anti-AR 27mer "Blunt/Fray" DsiRNA Agents

5'-GCAGUUAGGGCUGGGAAGGGUCUAC$^{A}$A-3' (SEQ ID NO: 4119)
3'-CGUCAAUCCCGACCCUUCCCAGAUG$_{G}$G-5' (SEQ ID NO: 1941)

AR-1150 Target: 5'-GCAGTTAGGGCTGGGAAGGGTCTACCC-3' (SEQ ID NO: 2346)

5'-CAGUUAGGGCUGGGAAGGGUCUACC$^{A}$C-3' (SEQ ID NO: 4120)
3'-GUCAAUCCCGACCCUUCCCAGAUGG$_{G}$A-5' (SEQ ID NO: 1942)

AR-1151 Target: 5'-CAGTTAGGGCTGGGAAGGGTCTACCCT-3' (SEQ ID NO: 2347)

5'-AGUUAGGGCUGGGAAGGGUCUACCC$^{C}$A-3' (SEQ ID NO: 4121)
3'-UCAAUCCCGACCCUUCCCAGAUGGG$_{A}$G-5' (SEQ ID NO: 1943)

AR-1152 Target: 5'-AGTTAGGGCTGGGAAGGGTCTACCCTC-3' (SEQ ID NO: 2348)

5'-GUUAGGGCUGGGAAGGGUCUACCCU$^{A}$A-3' (SEQ ID NO: 4122)
3'-CAAUCCCGACCCUUCCCAGAUGGGA$_{G}$C-5' (SEQ ID NO: 1944)

AR-1153 Target: 5'-GTTAGGGCTGGGAAGGGTCTACCCTCG-3' (SEQ ID NO: 2349)

5'-UUAGGGCUGGGAAGGGUCUACCCUC$^{A}$A-3' (SEQ ID NO: 4123)
3'-AAUCCCGACCCUUCCCAGAUGGGAG$_{C}$C-5' (SEQ ID NO: 1945)

AR-1154 Target: 5'-TTAGGGCTGGGAAGGGTCTACCCTCGG-3' (SEQ ID NO: 2350)

5'-UAGGGCUGGGAAGGGUCUACCCUCG$^{A}$A-3' (SEQ ID NO: 4124)
3'-AUCCCGACCCUUCCCAGAUGGGAGC$_{G}$C-5' (SEQ ID NO: 1946)

AR-1155 Target: 5'-TAGGGCTGGGAAGGGTCTACCCTCGGC-3' (SEQ ID NO: 2351)

5'-AGGGCUGGGAAGGGUCUACCCUCGG$^{A}$A-3' (SEQ ID NO: 4125)
3'-UCCCGACCCUUCCCAGAUGGGAGCC$_{G}$G-5' (SEQ ID NO: 1947)

AR-1156 Target: 5'-AGGGCTGGGAAGGGTCTACCCTCGGCC-3' (SEQ ID NO: 2352)

5'-CUUUCCAGAAUCUGUUCCAGAGCGU$^{A}$A-3' (SEQ ID NO: 4126)
3'-GAAAGGUCUUAGACAAGGUCUCGCA$_{C}$G-5' (SEQ ID NO: 1948)

AR-1206 Target: 5'-CTTTCCAGAATCTGTTCCAGAGCGTGC-3' (SEQ ID NO: 2353)

5'-UUUCCAGAAUCUGUUCCAGAGCGUG$^{A}$A-3' (SEQ ID NO: 4127)
3'-AAAGGUCUUAGACAAGGUCUCGCAC$_{C}$G-5' (SEQ ID NO: 1949)

AR-1207 Target: 5'-TTTCCAGAATCTGTTCCAGAGCGTGCG-3' (SEQ ID NO: 2354)

5'-UUCCAGAAUCUGUUCCAGAGCGUGC$^{A}$A-3' (SEQ ID NO: 4128)
3'-AAGGUCUUAGACAAGGUCUCGCACG$_{C}$G-5' (SEQ ID NO: 1950)

AR-1208 Target: 5'-TTCCAGAATCTGTTCCAGAGCGTGCGC-3' (SEQ ID NO: 2355)

5'-UCCAGAAUCUGUUCCAGAGCGUGCG$^{A}$A-3' (SEQ ID NO: 4129)
3'-AGGUCUUAGACAAGGUCUCGCACGC$_{G}$G-5' (SEQ ID NO: 1951)

AR-1209 Target: 5'-TCCAGAATCTGTTCCAGAGCGTGCGCG-3' (SEQ ID NO: 2356)

5'-CCAGAAUCUGUUCCAGAGCGUGCGC$^{A}$C-3' (SEQ ID NO: 4130)
3'-GGUCUUAGACAAGGUCUCGCACGCG$_{C}$U-5' (SEQ ID NO: 1952)

AR-1210 Target: 5'-CCAGAATCTGTTCCAGAGCGTGCGCGA-3' (SEQ ID NO: 2357)

TABLE 5-continued

Selected Human Anti-AR 27mer "Blunt/Fray" DsiRNA Agents

5'-CAGAAUCUGUUCCAGAGCGUGCGCG$^{\text{C}}$C-3' (SEQ ID NO: 4131)
3'-GUCUUAGACAAGGUCUCGCACGCGC$_{\text{U}}$U-5' (SEQ ID NO: 1953)

AR-1211 Target: 5'-CAGAATCTGTTCCAGAGCGTGCGCGAA-3' (SEQ ID NO: 2358)

5'-AGAAUCUGUUCCAGAGCGUGCGCGA$^{\text{C}}$A-3' (SEQ ID NO: 4132)
3'-UCUUAGACAAGGUCUCGCACGCGCU$_{\text{C}}$-5' (SEQ ID NO: 1954)

AR-1212 Target: 5'-AGAATCTGTTCCAGAGCGTGCGCGAAG-3' (SEQ ID NO: 2359)

5'-GAAUCUGUUCCAGAGCGUGCGCGAA$^{\text{A}}$C-3' (SEQ ID NO: 4133)
3'-CUUAGACAAGGUCUCGCACGCGCUU$_{\text{A}}$-5' (SEQ ID NO: 1955)

AR-1213 Target: 5'-GAATCTGTTCCAGAGCGTGCGCGAAGT-3' (SEQ ID NO: 2360)

5'-AAUCUGUUCCAGAGCGUGCGCGAAG$^{\text{C}}$A-3' (SEQ ID NO: 4134)
3'-UUAGACAAGGUCUCGCACGCGCUUC$_{\text{A}}$-5' (SEQ ID NO: 1956)

AR-1214 Target: 5'-AATCTGTTCCAGAGCGTGCGCGAAGTG-3' (SEQ ID NO: 2361)

5'-AUCUGUUCCAGAGCGUGCGCGAAGU$^{\text{A}}$C-3' (SEQ ID NO: 4135)
3'-UAGACAAGGUCUCGCACGCGCUUCA$_{\text{C}}$U-5' (SEQ ID NO: 1957)

AR-1215 Target: 5'-ATCTGTTCCAGAGCGTGCGCGAAGTGA-3' (SEQ ID NO: 2362)

5'-UCUGUUCCAGAGCGUGCGCGAAGUG$^{\text{C}}$C-3' (SEQ ID NO: 4136)
3'-AGACAAGGUCUCGCACGCGCUUCAC$_{\text{U}}$A-5' (SEQ ID NO: 1958)

AR-1216 Target: 5'-TCTGTTCCAGAGCGTGCGCGAAGTGAT-3' (SEQ ID NO: 2363)

5'-CUGUUCCAGAGCGUGCGCGAAGUGA$^{\text{C}}$A-3' (SEQ ID NO: 4137)
3'-GACAAGGUCUCGCACGCGCUUCACU$_{\text{A}}$G-5' (SEQ ID NO: 1959)

AR-1217 Target: 5'-CTGTTCCAGAGCGTGCGCGAAGTGATC-3' (SEQ ID NO: 2364)

5'-UGUUCCAGAGCGUGCGCGAAGUGAU$^{\text{A}}$A-3' (SEQ ID NO: 4138)
3'-ACAAGGUCUCGCACGCGCUUCACUA$_{\text{G}}$-5' (SEQ ID NO: 1960)

AR-1218 Target: 5'-TGTTCCAGAGCGTGCGCGAAGTGATCC-3' (SEQ ID NO: 2365)

5'-GGCGCCAGUUUGCUGCUGCUGCAGC$^{\text{C}}$A-3' (SEQ ID NO: 4139)
3'-CCGCGGUCAAACGACGACGACGUCG$_{\text{U}}$C-5' (SEQ ID NO: 1961)

AR-1292 Target: 5'-GGCGCCAGTTTGCTGCTGCTGCAGCAG-3' (SEQ ID NO: 2366)

5'-UUGCUGCUGCUGCAGCAGCAGCAGC$^{\text{C}}$A-3' (SEQ ID NO: 4140)
3'-AACGACGACGACGUCGUCGUCGUCG$_{\text{U}}$C-5' (SEQ ID NO: 1962)

AR-1301 Target: 5'-TTGCTGCTGCTGCAGCAGCAGCAGCAG-3' (SEQ ID NO: 2367)

5'-GCGUCCCAGAGCCUGGAGCCGCCGU$^{\text{A}}$A-3' (SEQ ID NO: 4141)
3'-CGCAGGGUCUCGGACCUCGGCGGCA$_{\text{C}}$C-5' (SEQ ID NO: 1963)

AR-1533 Target: 5'-GCGTCCCAGAGCCTGGAGCCGCCGTGG-3' (SEQ ID NO: 2368)

5'-GGCUGCCGCAGCAGCUGCCAGCACC$^{\text{C}}$A-3' (SEQ ID NO: 4142)
3'-CCGACGGCGUCGUCGACGGUCGUGG$_{\text{A}}$G-5' (SEQ ID NO: 1964)

AR-1572 Target: 5'-GGCTGCCGCAGCAGCTGCCAGCACCTC-3' (SEQ ID NO: 2369)

TABLE 5-continued

Selected Human Anti-AR 27mer "Blunt/Fray" DsiRNA Agents

5'-CGCAGCAGCUGCCAGCACCUCCGGA$^{AA-3'}$ (SEQ ID NO: 4143)
3'-GCGUCGUCGACGGUCGUGGAGGCCU$_{GC-5'}$ (SEQ ID NO: 1965)

AR-1578 Target: 5'-CGCAGCAGCTGCCAGCACCTCCGGACG-3' (SEQ ID NO: 2370)

5'-CCCAUCCACGUUGUCCCUGCUGGGC$^{AA-3'}$ (SEQ ID NO: 4144)
3'-GGGUAGGUGCAACAGGGACGACCCG$_{GG-5'}$ (SEQ ID NO: 1966)

AR-1621 Target: 5'-CCCATCCACGTTGTCCCTGCTGGGCCC-3' (SEQ ID NO: 2371)

5'-CCGGCUUAAGCAGCUGCUCCGCUGA$^{AA-3'}$ (SEQ ID NO: 4145)
3'-GGCCGAAUUCGUCGACGAGGCGACU$_{GG-5'}$ (SEQ ID NO: 1967)

AR-1656 Target: 5'-CCGGCTTAAGCAGCTGCTCCGCTGACC-3' (SEQ ID NO: 2372)

5'-CGGCUUAAGCAGCUGCUCCGCUGAC$^{AC-3'}$ (SEQ ID NO: 4146)
3'-GCCGAAUUCGUCGACGAGGCGACUG$_{GA-5'}$ (SEQ ID NO: 1968)

AR-1657 Target: 5'-CGGCTTAAGCAGCTGCTCCGCTGACCT-3' (SEQ ID NO: 2373)

5'-UAAGCAGCUGCUCCGCUGACCUUAA$^{CA-3'}$ (SEQ ID NO: 4147)
3'-AUUCGUCGACGAGGCGACUGGAAUU$_{UC-5'}$ (SEQ ID NO: 1969)

AR-1662 Target: 5'-TAAGCAGCTGCTCCGCTGACCTTAAAG-3' (SEQ ID NO: 2374)

5'-AUGCAACUCCUUCAGCAACAGCAGC$^{CA-3'}$ (SEQ ID NO: 4148)
3'-UACGUUGAGGAAGUCGUUGUCGUCG$_{UC-5'}$ (SEQ ID NO: 1970)

AR-1712 Target: 5'-ATGCAACTCCTTCAGCAACAGCAGCAG-3' (SEQ ID NO: 2375)

5'-ACCAUUUCUGACAACGCCAAGGAGU$^{CA-3'}$ (SEQ ID NO: 4149)
3'-UGGUAAAGACUGUUGCGGUUCCUCA$_{AC-5'}$ (SEQ ID NO: 1971)

AR-1832 Target: 5'-ACCATTTCTGACAACGCCAAGGAGTTG-3' (SEQ ID NO: 2376)

5'-CCACUUUUGGGAGUUCCACCCGCUG$^{CA-3'}$ (SEQ ID NO: 4150)
3'-GGUGAAAACCCUCAAGGUGGGCGAC$_{AC-5'}$ (SEQ ID NO: 1972)

AR-1952 Target: 5'-CCACTTTTGGGAGTTCCACCCGCTGTG-3' (SEQ ID NO: 2377)

5'-CAGGCAAGAGCACUGAAGAUACUGC$^{CA-3'}$ (SEQ ID NO: 4151)
3'-GUCCGUUCUCGUCACUUCUAUGACG$_{AC-5'}$ (SEQ ID NO: 1973)

AR-2037 Target: 5'-CAGGCAAGAGCACTGAAGATACTGCTG-3' (SEQ ID NO: 2378)

5'-CUGGCAGCGCUGCAGCAGGGAGCUC$^{AA-3'}$ (SEQ ID NO: 4152)
3'-GACCGUCGCGACGUCGUCCCUCGAG$_{GC-5'}$ (SEQ ID NO: 1974)

AR-2124 Target: 5'-CTGGCAGCGCTGCAGCAGGGAGCTCCG-3' (SEQ ID NO: 2379)

5'-AGUCGCGACUACUACAACUUUCCAC$^{CA-3'}$ (SEQ ID NO: 4153)
3'-UCAGCGCUGAUGAUGUUGAAAGGUG$_{AC-5'}$ (SEQ ID NO: 1975)

AR-2222 Target: 5'-AGTCGCGACTACTACAACTTTCCACTG-3' (SEQ ID NO: 2380)

5'-GUCGCGACUACUACAACUUUCCACU$^{AA-3'}$ (SEQ ID NO: 4154)
3'-CAGCGCUGAUGAUGUUGAAAGGUGA$_{CC-5'}$ (SEQ ID NO: 1976)

AR-2223 Target: 5'-GTCGCGACTACTACAACTTTCCACTGG-3' (SEQ ID NO: 2381)

TABLE 5-continued

Selected Human Anti-AR 27mer "Blunt/Fray" DsiRNA Agents

5'-UCGCGACUACUACAACUUUCCACUG$^{AA-3'}$ (SEQ ID NO: 4155)
3'-AGCGCUGAUGAUGUUGAAAGGUGAC$_{CG-5'}$ (SEQ ID NO: 1977)

AR-2224 Target: 5'-TCGCGACTACTACAACTTTCCACTGGC-3' (SEQ ID NO: 2382)

5'-GCUCGCAUCAAGCUGGAGAACCCGC$^{CA-3'}$ (SEQ ID NO: 4156)
3'-CGAGCGUAGUUCGACCUCUUGGGCG$_{AC-5'}$ (SEQ ID NO: 1978)

AR-2294 Target: 5'-GCTCGCATCAAGCTGGAGAACCCGCTG-3' (SEQ ID NO: 2383)

5'-GCUGGACUACGGCAGCGCCUGGGCG$^{AA-3'}$ (SEQ ID NO: 4157)
3'-CGACCUGAUGCCGUCGCGGACCCGC$_{CG-5'}$ (SEQ ID NO: 1979)

AR-2317 Target: 5'-GCTGGACTACGGCAGCGCCTGGGCGGC-3' (SEQ ID NO: 2384)

5'-CUGGACUACGGCAGCGCCUGGGCGG$^{AC-3'}$ (SEQ ID NO: 4158)
3'-GACCUGAUGCCGUCGCGGACCCGCC$_{GA-5'}$ (SEQ ID NO: 1980)

AR-2318 Target: 5'-CTGGACTACGGCAGCGCCTGGGCGGCT-3' (SEQ ID NO: 2385)

5'-UGGACUACGGCAGCGCCUGGGCGGC$^{CA-3'}$ (SEQ ID NO: 4159)
3'-ACCUGAUGCCGUCGCGGACCCGCCG$_{AC-5'}$ (SEQ ID NO: 1981)

AR-2319 Target: 5'-TGGACTACGGCAGCGCCTGGGCGGCTG-3' (SEQ ID NO: 2386)

5'-GGACUACGGCAGCGCCUGGGCGGCU$^{AA-3'}$ (SEQ ID NO: 4160)
3'-CCUGAUGCCGUCGCGGACCCGCCGA$_{CG-5'}$ (SEQ ID NO: 1982)

AR-2320 Target: 5'-GGACTACGGCAGCGCCTGGGCGGCTGC-3' (SEQ ID NO: 2387)

5'-UGGCGCGGGUGCAGCGGGACCCGGU$^{CA-3'}$ (SEQ ID NO: 4161)
3'-ACCGCGCCCACGUCGCCCUGGGCCA$_{AG-5'}$ (SEQ ID NO: 1983)

AR-2386 Target: 5'-TGGCGCGGGTGCAGCGGGACCCGGTTC-3' (SEQ ID NO: 2388)

5'-GGCUGGCGGGCCAGGAAAGCGACUU$^{AC-3'}$ (SEQ ID NO: 4162)
3'-CCGACCGCCCGGUCCUUUCGCUGAA$_{GU-5'}$ (SEQ ID NO: 1984)

AR-2607 Target: 5'-GGCTGGCGGGCCAGGAAAGCGACTTCA-3' (SEQ ID NO: 2389)

5'-GUACCCUGGCGGCAUGGUGAGCAGA$^{AC-3'}$ (SEQ ID NO: 4163)
3'-CAUGGGACCGCCGUACCACUCGUCU$_{CA-5'}$ (SEQ ID NO: 1985)

AR-2650 Target: 5'-GTACCCTGGCGGCATGGTGAGCAGAGT-3' (SEQ ID NO: 2390)

5'-UGGAUGGAUAGCUACUCCGGACCUU$^{CA-3'}$ (SEQ ID NO: 4164)
3'-ACCUACCUAUCGAUGAGGCCUGGAA$_{UG-5'}$ (SEQ ID NO: 1986)

AR-2720 Target: 5'-TGGATGGATAGCTACTCCGGACCTTAC-3' (SEQ ID NO: 2391)

5'-CCCAGAAGACCUGCCUGAUCUGUGG$^{CA-3'}$ (SEQ ID NO: 4165)
3'-GGGUCUUCUGGACGGACUAGACACC$_{UC-5'}$ (SEQ ID NO: 1987)

AR-2808 Target: 5'-CCCAGAAGACCTGCCTGATCTGTGGAG-3' (SEQ ID NO: 2392)

5'-CCAGAAGACCUGCCUGAUCUGUGGA$^{AC-3'}$ (SEQ ID NO: 4166)
3'-GGUCUUCUGGACGGACUAGACACCU$_{CU-5'}$ (SEQ ID NO: 1988)

AR-2809 Target: 5'-CCAGAAGACCTGCCTGATCTGTGGAGA-3' (SEQ ID NO: 2393)

TABLE 5-continued

Selected Human Anti-AR 27mer "Blunt/Fray" DsiRNA Agents

5'-CAGAAGACCUGCCUGAUCUGUGGAG$^{CC-3'}$ (SEQ ID NO: 4167)
3'-GUCUUCUGGACGGACUAGACACCUC$_{UA-5'}$ (SEQ ID NO: 1989)

AR-2810 Target: 5'-CAGAAGACCTGCCTGATCTGTGGAGAT-3' (SEQ ID NO: 2394)

5'-AGAAGACCUGCCUGAUCUGUGGAGA$^{CA-3'}$ (SEQ ID NO: 4168)
3'-UCUUCUGGACGGACUAGACACCUCU$_{AC-5'}$ (SEQ ID NO: 1990)

AR-2811 Target: 5'-AGAAGACCTGCCTGATCTGTGGAGATG-3' (SEQ ID NO: 2395)

5'-GAAGACCUGCCUGAUCUGUGGAGAU$^{AC-3'}$ (SEQ ID NO: 4169)
3'-CUUCUGGACGGACUAGACACCUCUA$_{CU-5'}$ (SEQ ID NO: 1991)

AR-2812 Target: 5'-GAAGACCTGCCTGATCTGTGGAGATGA-3' (SEQ ID NO: 2396)

5'-AAGACCUGCCUGAUCUGUGGAGAUG$^{CC-3'}$ (SEQ ID NO: 4170)
3'-UUCUGGACGGACUAGACACCUCUAC$_{UU-5'}$ (SEQ ID NO: 1992)

AR-2813 Target: 5'-AAGACCTGCCTGATCTGTGGAGATGAA-3' (SEQ ID NO: 2397)

5'-AGACCUGCCUGAUCUGUGGAGAUGA$^{CA-3'}$ (SEQ ID NO: 4171)
3'-UCUGGACGGACUAGACACCUCUACU$_{UC-5'}$ (SEQ ID NO: 1993)

AR-2814 Target: 5'-AGACCTGCCTGATCTGTGGAGATGAAG-3' (SEQ ID NO: 2398)

5'-GACCUGCCUGAUCUGUGGAGAUGAA$^{AA-3'}$ (SEQ ID NO: 4172)
3'-CUGGACGGACUAGACACCUCUACUU$_{CG-5'}$ (SEQ ID NO: 1994)

AR-2815 Target: 5'-GACCTGCCTGATCTGTGGAGATGAAGC-3' (SEQ ID NO: 2399)

5'-ACCUGCCUGAUCUGUGGAGAUGAAG$^{AC-3'}$ (SEQ ID NO: 4173)
3'-UGGACGGACUAGACACCUCUACUUC$_{GA-5'}$ (SEQ ID NO: 1995)

AR-2816 Target: 5'-ACCTGCCTGATCTGTGGAGATGAAGCT-3' (SEQ ID NO: 2400)

5'-CCUGCCUGAUCUGUGGAGAUGAAGC$^{CC-3'}$ (SEQ ID NO: 4174)
3'-GGACGGACUAGACACCUCUACUUCG$_{AA-5'}$ (SEQ ID NO: 1996)

AR-2817 Target: 5'-CCTGCCTGATCTGTGGAGATGAAGCTT-3' (SEQ ID NO: 2401)

5'-CUGCCUGAUCUGUGGAGAUGAAGCU$^{CA-3'}$ (SEQ ID NO: 4175)
3'-GACGGACUAGACACCUCUACUUCGA$_{AG-5'}$ (SEQ ID NO: 1997)

AR-2818 Target: 5'-CTGCCTGATCTGTGGAGATGAAGCTTC-3' (SEQ ID NO: 2402)

5'-UGCCUGAUCUGUGGAGAUGAAGCUU$^{AC-3'}$ (SEQ ID NO: 4176)
3'-ACGGACUAGACACCUCUACUUCGAA$_{GA-5'}$ (SEQ ID NO: 1998)

AR-2819 Target: 5'-TGCCTGATCTGTGGAGATGAAGCTTCT-3' (SEQ ID NO: 2403)

5'-GCCUGAUCUGUGGAGAUGAAGCUUC$^{CA-3'}$ (SEQ ID NO: 4177)
3'-CGGACUAGACACCUCUACUUCGAAG$_{AC-5'}$ (SEQ ID NO: 1999)

AR-2820 Target: 5'-GCCTGATCTGTGGAGATGAAGCTTCTG-3' (SEQ ID NO: 2404)

5'-CCUGAUCUGUGGAGAUGAAGCUUCU$^{AA-3'}$ (SEQ ID NO: 4178)
3'-GGACUAGACACCUCUACUUCGAAGA$_{CC-5'}$ (SEQ ID NO: 2000)

AR-2821 Target: 5'-CCTGATCTGTGGAGATGAAGCTTCTGG-3' (SEQ ID NO: 2405)

TABLE 5-continued

Selected Human Anti-AR 27mer "Blunt/Fray" DsiRNA Agents

5'-CUGAUCUGUGGAGAUGAAGCUUCUG$^{AA}$-3' (SEQ ID NO: 4179)
3'-GACUAGACACCUCUACUUCGAAGAC$_{CC}$-5' (SEQ ID NO: 2001)

AR-2822 Target: 5'-CTGATCTGTGGAGATGAAGCTTCTGGG-3' (SEQ ID NO: 2406)

5'-UGAUCUGUGGAGAUGAAGCUUCUGG$^{AC}$-3' (SEQ ID NO: 4180)
3'-ACUAGACACCUCUACUUCGAAGACC$_{CA}$-5' (SEQ ID NO: 2002)

AR-2823 Target: 5'-TGATCTGTGGAGATGAAGCTTCTGGGT-3' (SEQ ID NO: 2407)

5'-GAUCUGUGGAGAUGAAGCUUCUGGG$^{CA}$-3' (SEQ ID NO: 4181)
3'-CUAGACACCUCUACUUCGAAGACCC$_{AC}$-5' (SEQ ID NO: 2003)

AR-2824 Target: 5'-GATCTGTGGAGATGAAGCTTCTGGGTG-3' (SEQ ID NO: 2408)

5'-AUCUGUGGAGAUGAAGCUUCUGGGU$^{AC}$-3' (SEQ ID NO: 4182)
3'-UAGACACCUCUACUUCGAAGACCCA$_{CA}$-5' (SEQ ID NO: 2004)

AR-2825 Target: 5'-ATCTGTGGAGATGAAGCTTCTGGGTGT-3' (SEQ ID NO: 2409)

5'-UCUGUGGAGAUGAAGCUUCUGGGUG$^{CA}$-3' (SEQ ID NO: 4183)
3'-AGACACCUCUACUUCGAAGACCCAC$_{AG}$-5' (SEQ ID NO: 2005)

AR-2826 Target: 5'-TCTGTGGAGATGAAGCTTCTGGGTGTC-3' (SEQ ID NO: 2410)

5'-CUGUGGAGAUGAAGCUUCUGGGUGU$^{AC}$-3' (SEQ ID NO: 4184)
3'-GACACCUCUACUUCGAAGACCCACA$_{GU}$-5' (SEQ ID NO: 2006)

AR-2827 Target: 5'-CTGTGGAGATGAAGCTTCTGGGTGTCA-3' (SEQ ID NO: 2411)

5'-GCUUCUGGGUGUCACUAUGGAGCUC$^{CA}$-3' (SEQ ID NO: 4185)
3'-CGAAGACCCACAGUGAUACCUCGAG$_{AG}$-5' (SEQ ID NO: 2007)

AR-2840 Target: 5'-GCTTCTGGGTGTCACTATGGAGCTCTC-3' (SEQ ID NO: 2412)

5'-UGGAGCUCUCACAUGUGGAAGCUGC$^{CC}$-3' (SEQ ID NO: 4186)
3'-ACCUCGAGAGUGUACACCUUCGACG$_{UU}$-5' (SEQ ID NO: 2008)

AR-2857 Target: 5'-TGGAGCTCTCACATGTGGAAGCTGCAA-3' (SEQ ID NO: 2413)

5'-GAAGCUGCAAGGUCUUCUUCAAAAG$^{CA}$-3' (SEQ ID NO: 4187)
3'-CUUCGACGUUCCAGAAGAAGUUUUC$_{UC}$-5' (SEQ ID NO: 2009)

AR-2874 Target: 5'-GAAGCTGCAAGGTCTTCTTCAAAAGAG-3' (SEQ ID NO: 2414)

5'-AAGCUGCAAGGUCUUCUUCAAAAGA$^{AA}$-3' (SEQ ID NO: 4188)
3'-UUCGACGUUCCAGAAGAAGUUUUCU$_{CG}$-5' (SEQ ID NO: 2010)

AR-2875 Target: 5'-AAGCTGCAAGGTCTTCTTCAAAAGAGC-3' (SEQ ID NO: 2415)

5'-AGCUGCAAGGUCUUCUUCAAAAGAG$^{AA}$-3' (SEQ ID NO: 4189)
3'-UCGACGUUCCAGAAGAAGUUUUCUC$_{GG}$-5' (SEQ ID NO: 2011)

AR-2876 Target: 5'-AGCTGCAAGGTCTTCTTCAAAAGAGCC-3' (SEQ ID NO: 2416)

5'-GCUGCAAGGUCUUCUUCAAAAGAGC$^{AA}$-3' (SEQ ID NO: 4190)
3'-CGACGUUCCAGAAGAAGUUUUCUCG$_{GC}$-5' (SEQ ID NO: 2012)

AR-2877 Target: 5'-GCTGCAAGGTCTTCTTCAAAAGAGCCG-3' (SEQ ID NO: 2417)

TABLE 5-continued

Selected Human Anti-AR 27mer "Blunt/Fray" DsiRNA Agents

5'-CUGCAAGGUCUUCUUCAAAAGAGCC$^{A-3'}_{A}$ (SEQ ID NO: 4191)
3'-GACGUUCCAGAAGAAGUUUUCUCGG$_{G-5'}^{C}$ (SEQ ID NO: 2013)

AR-2878 Target: 5'-CTGCAAGGTCTTCTTCAAAAGAGCCGC-3' (SEQ ID NO: 2418)

5'-UGCAAGGUCUUCUUCAAAAGAGCCG$^{C-3'}_{A}$ (SEQ ID NO: 4192)
3'-ACGUUCCAGAAGAAGUUUUCUCGGC$_{A-5'}^{G}$ (SEQ ID NO: 2014)

AR-2879 Target: 5'-TGCAAGGTCTTCTTCAAAAGAGCCGCT-3' (SEQ ID NO: 2419)

5'-GCAAGGUCUUCUUCAAAAGAGCCGC$^{A-3'}_{C}$ (SEQ ID NO: 4193)
3'-CGUUCCAGAAGAAGUUUUCUCGGCG$_{C-5'}^{A}$ (SEQ ID NO: 2015)

AR-2880 Target: 5'-GCAAGGTCTTCTTCAAAAGAGCCGCTG-3' (SEQ ID NO: 2420)

5'-CAAGGUCUUCUUCAAAAGAGCCGCU$^{C-3'}_{A}$ (SEQ ID NO: 4194)
3'-GUUCCAGAAGAAGUUUUCUCGGCGA$_{U-5'}^{C}$ (SEQ ID NO: 2016)

AR-2881 Target: 5'-CAAGGTCTTCTTCAAAAGAGCCGCTGA-3' (SEQ ID NO: 2421)

5'-AAGGUCUUCUUCAAAAGAGCCGCUG$^{C-3'}_{C}$ (SEQ ID NO: 4195)
3'-UUCCAGAAGAAGUUUUCUCGGCGAC$_{U-5'}^{U}$ (SEQ ID NO: 2017)

AR-2882 Target: 5'-AAGGTCTTCTTCAAAAGAGCCGCTGAA-3' (SEQ ID NO: 2422)

5'-AGGUCUUCUUCAAAAGAGCCGCUGA$^{A-3'}_{C}$ (SEQ ID NO: 4196)
3'-UCCAGAAGAAGUUUUCUCGGCGACU$_{C-5'}^{U}$ (SEQ ID NO: 2018)

AR-2883 Target: 5'-AGGTCTTCTTCAAAAGAGCCGCTGAAG-3' (SEQ ID NO: 2423)

5'-GGUCUUCUUCAAAAGAGCCGCUGAA$^{A-3'}_{A}$ (SEQ ID NO: 4197)
3'-CCAGAAGAAGUUUUCUCGGCGACUU$_{C-5'}^{C}$ (SEQ ID NO: 2019)

AR-2884 Target: 5'-GGTCTTCTTCAAAAGAGCCGCTGAAGG-3' (SEQ ID NO: 2424)

5'-GUCUUCUUCAAAAGAGCCGCUGAAG$^{A-3'}_{A}$ (SEQ ID NO: 4198)
3'-CAGAAGAAGUUUUCUCGGCGACUUC$_{C-5'}^{C}$ (SEQ ID NO: 2020)

AR-2885 Target: 5'-GTCTTCTTCAAAAGAGCCGCTGAAGGG-3' (SEQ ID NO: 2425)

5'-UCUUCUUCAAAAGAGCCGCUGAAGG$^{C-3'}_{A}$ (SEQ ID NO: 4199)
3'-AGAAGAAGUUUUCUCGGCGACUUCC$_{U-5'}^{C}$ (SEQ ID NO: 2021)

AR-2886 Target: 5'-TCTTCTTCAAAAGAGCCGCTGAAGGGA-3' (SEQ ID NO: 2426)

5'-CUUCUUCAAAAGAGCCGCUGAAGGG$^{C-3'}_{C}$ (SEQ ID NO: 4200)
3'-GAAGAAGUUUUCUCGGCGACUUCCC$_{U-5'}^{U}$ (SEQ ID NO: 2022)

AR-2887 Target: 5'-CTTCTTCAAAAGAGCCGCTGAAGGGAA-3' (SEQ ID NO: 2427)

5'-UUCUUCAAAAGAGCCGCUGAAGGGA$^{C-3'}_{C}$ (SEQ ID NO: 4201)
3'-AAGAAGUUUUCUCGGCGACUUCCCU$_{U-5'}^{U}$ (SEQ ID NO: 2023)

AR-2888 Target: 5'-TTCTTCAAAAGAGCCGCTGAAGGGAAA-3' (SEQ ID NO: 2428)

5'-UCUUCAAAAGAGCCGCUGAAGGGAA$^{A-3'}_{C}$ (SEQ ID NO: 4202)
3'-AGAAGUUUUCUCGGCGACUUCCCUU$_{G-5'}^{U}$ (SEQ ID NO: 2024)

AR-2889 Target: 5'-TCTTCAAAAGAGCCGCTGAAGGGAAAC-3' (SEQ ID NO: 2429)

TABLE 5-continued

Selected Human Anti-AR 27mer "Blunt/Fray" DsiRNA Agents

5'-CUUCAAAAGAGCCGCUGAAGGGAAA$^{AC-3'}$ (SEQ ID NO: 4203)
3'-GAAGUUUUCUCGGCGACUUCCCUUU$_{GU-5'}$ (SEQ ID NO: 2025)

AR-2890 Target: 5'-CTTCAAAAGAGCCGCTGAAGGGAAACA-3' (SEQ ID NO: 2430)

5'-UUCAAAAGAGCCGCUGAAGGGAAAC$^{CA-3'}$ (SEQ ID NO: 4204)
3'-AAGUUUUCUCGGCGACUUCCCUUUG$_{UC-5'}$ (SEQ ID NO: 2026)

AR-2891 Target: 5'-TTCAAAAGAGCCGCTGAAGGGAAACAG-3' (SEQ ID NO: 2431)

5'-UCAAAAGAGCCGCUGAAGGGAAACA$^{AC-3'}$ (SEQ ID NO: 4205)
3'-AGUUUUCUCGGCGACUUCCCUUUGU$_{CU-5'}$ (SEQ ID NO: 2027)

AR-2892 Target: 5'-TCAAAAGAGCCGCTGAAGGGAAACAGA-3' (SEQ ID NO: 2432)

5'-CAAAAGAGCCGCUGAAGGGAAACAG$^{CC-3'}$ (SEQ ID NO: 4206)
3'-GUUUUCUCGGCGACUUCCCUUUGUC$_{UU-5'}$ (SEQ ID NO: 2028)

AR-2893 Target: 5'-CAAAAGAGCCGCTGAAGGGAAACAGAA-3' (SEQ ID NO: 2433)

5'-AAAAGAGCCGCUGAAGGGAAACAGA$^{CA-3'}$ (SEQ ID NO: 4207)
3'-UUUUCUCGGCGACUUCCCUUUGUCU$_{UC-5'}$ (SEQ ID NO: 2029)

AR-2894 Target: 5'-AAAAGAGCCGCTGAAGGGAAACAGAAG-3' (SEQ ID NO: 2434)

5'-AAAGAGCCGCUGAAGGGAAACAGAA$^{AC-3'}$ (SEQ ID NO: 4208)
3'-UUUCUCGGCGACUUCCCUUUGUCUU$_{CA-5'}$ (SEQ ID NO: 2030)

AR-2895 Target: 5'-AAAGAGCCGCTGAAGGGAAACAGAAGT-3' (SEQ ID NO: 2435)

5'-AAGAGCCGCUGAAGGGAAACAGAAG$^{CC-3'}$ (SEQ ID NO: 4209)
3'-UUCUCGGCGACUUCCCUUUGUCUUC$_{AU-5'}$ (SEQ ID NO: 2031)

AR-2896 Target: 5'-AAGAGCCGCTGAAGGGAAACAGAAGTA-3' (SEQ ID NO: 2436)

5'-AGAGCCGCUGAAGGGAAACAGAAGU$^{CA-3'}$ (SEQ ID NO: 4210)
3'-UCUCGGCGACUUCCCUUUGUCUUCA$_{UG-5'}$ (SEQ ID NO: 2032)

AR-2897 Target: 5'-AGAGCCGCTGAAGGGAAACAGAAGTAC-3' (SEQ ID NO: 2437)

5'-GAGCCGCUGAAGGGAAACAGAAGUA$^{AA-3'}$ (SEQ ID NO: 4211)
3'-CUCGGCGACUUCCCUUUGUCUUCAU$_{GG-5'}$ (SEQ ID NO: 2033)

AR-2898 Target: 5'-GAGCCGCTGAAGGGAAACAGAAGTACC-3' (SEQ ID NO: 2438)

5'-AGCCGCUGAAGGGAAACAGAAGUAC$^{AC-3'}$ (SEQ ID NO: 4212)
3'-UCGGCGACUUCCCUUUGUCUUCAUG$_{GA-5'}$ (SEQ ID NO: 2034)

AR-2899 Target: 5'-AGCCGCTGAAGGGAAACAGAAGTACCT-3' (SEQ ID NO: 2439)

5'-CCGCUGAAGGGAAACAGAAGUACCU$^{AC-3'}$ (SEQ ID NO: 4213)
3'-GGCGACUUCCCUUUGUCUUCAUGGA$_{CA-5'}$ (SEQ ID NO: 2035)

AR-2901 Target: 5'-CCGCTGAAGGGAAACAGAAGTACCTGT-3' (SEQ ID NO: 2440)

5'-CGCUGAAGGGAAACAGAAGUACCUG$^{CA-3'}$ (SEQ ID NO: 4214)
3'-GCGACUUCCCUUUGUCUUCAUGGAC$_{AC-5'}$ (SEQ ID NO: 2036)

AR-2902 Target: 5'-CGCTGAAGGGAAACAGAAGTACCTGTG-3' (SEQ ID NO: 2441)

TABLE 5-continued

Selected Human Anti-AR 27mer "Blunt/Fray" DsiRNA Agents

5'-CCUGUGCGCCAGCAGAAAUGAUUGC<sup>CA-3'</sup> (SEQ ID NO: 4215)
3'-GGACACGCGGUCGUCUUUACUAACG<sub>UG-5'</sub> (SEQ ID NO: 2037)

AR-2923 Target: 5'-CCTGTGCGCCAGCAGAAATGATTGCAC-3' (SEQ ID NO: 2442)

5'-GCAGAAAUGAUUGCACUAUUGAUAA<sup>CC-3'</sup> (SEQ ID NO: 4216)
3'-CGUCUUUACUAACGUGAUAACUAUU<sub>UA-5'</sub> (SEQ ID NO: 2038)

AR-2934 Target: 5'-GCAGAAATGATTGCACTATTGATAAAT-3' (SEQ ID NO: 2443)

5'-AAUGAUUGCACUAUUGAUAAAUUCC<sup>AC-3'</sup> (SEQ ID NO: 4217)
3'-UUACUAACGUGAUAACUAUUUAAGG<sub>CU-5'</sub> (SEQ ID NO: 2039)

AR-2939 Target: 5'-AATGATTGCACTATTGATAAATTCCGA-3' (SEQ ID NO: 2444)

5'-CACUAUUGAUAAAUUCCGAAGGAAA<sup>CC-3'</sup> (SEQ ID NO: 4218)
3'-GUGAUAACUAUUUAAGGCUUCCUUU<sub>UU-5'</sub> (SEQ ID NO: 2040)

AR-2947 Target: 5'-CACTATTGATAAATTCCGAAGGAAAA-3' (SEQ ID NO: 2445)

5'-UUCGGAAAUGUUAUGAAGCAGGGAU<sup>AC-3'</sup> (SEQ ID NO: 4219)
3'-AAGCCUUUACAAUACUUCGUCCCUA<sub>CU-5'</sub> (SEQ ID NO: 2041)

AR-2991 Target: 5'-TTCGGAAATGTTATGAAGCAGGGATGA-3' (SEQ ID NO: 2446)

5'-UCGGAAAUGUUAUGAAGCAGGGAUG<sup>CA-3'</sup> (SEQ ID NO: 4220)
3'-AGCCUUUACAAUACUUCGUCCCUAC<sub>UG-5'</sub> (SEQ ID NO: 2042)

AR-2992 Target: 5'-TCGGAAATGTTATGAAGCAGGGATGAC-3' (SEQ ID NO: 2447)

5'-CGGAAAUGUUAUGAAGCAGGGAUGA<sup>AC-3'</sup> (SEQ ID NO: 4221)
3'-GCCUUUACAAUACUUCGUCCCUACU<sub>GA-5'</sub> (SEQ ID NO: 2043)

AR-2993 Target: 5'-CGGAAATGTTATGAAGCAGGGATGACT-3' (SEQ ID NO: 2448)

5'-GGAAAUGUUAUGAAGCAGGGAUGAC<sup>CA-3'</sup> (SEQ ID NO: 4222)
3'-CCUUUACAAUACUUCGUCCCUACUG<sub>AG-5'</sub> (SEQ ID NO: 2044)

AR-2994 Target: 5'-GGAAATGTTATGAAGCAGGGATGACTC-3' (SEQ ID NO: 2449)

5'-GAAAUGUUAUGAAGCAGGGAUGACU<sup>AC-3'</sup> (SEQ ID NO: 4223)
3'-CUUUACAAUACUUCGUCCCUACUGA<sub>GA-5'</sub> (SEQ ID NO: 2045)

AR-2995 Target: 5'-GAAATGTTATGAAGCAGGGATGACTCT-3' (SEQ ID NO: 2450)

5'-AAAUGUUAUGAAGCAGGGAUGACUC<sup>CA-3'</sup> (SEQ ID NO: 4224)
3'-UUUACAAUACUUCGUCCCUACUGAG<sub>AC-5'</sub> (SEQ ID NO: 2046)

AR-2996 Target: 5'-AAATGTTATGAAGCAGGGATGACTCTG-3' (SEQ ID NO: 2451)

5'-AAUGUUAUGAAGCAGGGAUGACUCU<sup>AA-3'</sup> (SEQ ID NO: 4225)
3'-UUACAAUACUUCGUCCCUACUGAGA<sub>CC-5'</sub> (SEQ ID NO: 2047)

AR-2997 Target: 5'-AATGTTATGAAGCAGGGATGACTCTGG-3' (SEQ ID NO: 2452)

5'-AUGUUAUGAAGCAGGGAUGACUCUG<sup>AA-3'</sup> (SEQ ID NO: 4226)
3'-UACAAUACUUCGUCCCUACUGAGAC<sub>CC-5'</sub> (SEQ ID NO: 2048)

AR-2998 Target: 5'-ATGTTATGAAGCAGGGATGACTCTGGG-3' (SEQ ID NO: 2453)

TABLE 5-continued

Selected Human Anti-AR 27mer "Blunt/Fray" DsiRNA Agents

5'-UGUUAUGAAGCAGGGAUGACUCUGG$^{AC-3'}$ (SEQ ID NO: 4227)
3'-ACAAUACUUCGUCCCUACUGAGACC$_{CUC-5'}$ (SEQ ID NO: 2049)

AR-2999 Target: 5'-TGTTATGAAGCAGGGATGACTCTGGGA-3' (SEQ ID NO: 2454)

5'-GUUAUGAAGCAGGGAUGACUCUGGG$^{CA-3'}$ (SEQ ID NO: 4228)
3'-CAAUACUUCGUCCCUACUGAGACCC$_{UC-5'}$ (SEQ ID NO: 2050)

AR-3000 Target: 5'-GTTATGAAGCAGGGATGACTCTGGGAG-3' (SEQ ID NO: 2455)

5'-UUAUGAAGCAGGGAUGACUCUGGGA$^{AA-3'}$ (SEQ ID NO: 4229)
3'-AAUACUUCGUCCCUACUGAGACCCU$_{CG-5'}$ (SEQ ID NO: 2051)

AR-3001 Target: 5'-TTATGAAGCAGGGATGACTCTGGGAGC-3' (SEQ ID NO: 2456)

5'-UAUGAAGCAGGGAUGACUCUGGGAG$^{AA-3'}$ (SEQ ID NO: 4230)
3'-AUACUUCGUCCCUACUGAGACCCUC$_{GG-5'}$ (SEQ ID NO: 2052)

AR-3002 Target: 5'-TATGAAGCAGGGATGACTCTGGGAGCC-3' (SEQ ID NO: 2457)

5'-AUGAAGCAGGGAUGACUCUGGGAGC$^{AA-3'}$ (SEQ ID NO: 4231)
3'-UACUUCGUCCCUACUGAGACCCUCG$_{GG-5'}$ (SEQ ID NO: 2053)

AR-3003 Target: 5'-ATGAAGCAGGGATGACTCTGGGAGCCC-3' (SEQ ID NO: 2458)

5'-UGAAGCAGGGAUGACUCUGGGAGCC$^{AA-3'}$ (SEQ ID NO: 4232)
3'-ACUUCGUCCCUACUGAGACCCUCGG$_{GC-5'}$ (SEQ ID NO: 2054)

AR-3004 Target: 5'-TGAAGCAGGGATGACTCTGGGAGCCCG-3' (SEQ ID NO: 2459)

5'-GAAGCAGGGAUGACUCUGGGAGCCC$^{AA-3'}$ (SEQ ID NO: 4233)
3'-CUUCGUCCCUACUGAGACCCUCGGG$_{CC-5'}$ (SEQ ID NO: 2055)

AR-3005 Target: 5'-GAAGCAGGGATGACTCTGGGAGCCCGG-3' (SEQ ID NO: 2460)

5'-AAGCAGGGAUGACUCUGGGAGCCCG$^{AC-3'}$ (SEQ ID NO: 4234)
3'-UUCGUCCCUACUGAGACCCUCGGGC$_{CU-5'}$ (SEQ ID NO: 2056)

AR-3006 Target: 5'-AAGCAGGGATGACTCTGGGAGCCCGGA-3' (SEQ ID NO: 2461)

5'-AGCAGGGAUGACUCUGGGAGCCCGG$^{CC-3'}$ (SEQ ID NO: 4235)
3'-UCGUCCCUACUGAGACCCUCGGGCC$_{UU-5'}$ (SEQ ID NO: 2057)

AR-3007 Target: 5'-AGCAGGGATGACTCTGGGAGCCCGGAA-3' (SEQ ID NO: 2462)

5'-CUGAAGAAACUUGGUAAUCUGAAAC$^{CC-3'}$ (SEQ ID NO: 4236)
3'-GACUUCUUUGAACCAUUAGACUUUG$_{AU-5'}$ (SEQ ID NO: 2058)

AR-3035 Target: 5'-CTGAAGAAACTTGGTAATCTGAAACTA-3' (SEQ ID NO: 2463)

5'-UGAAACUACAGGAGGAAGGAGAGGC$^{CC-3'}$ (SEQ ID NO: 4237)
3'-ACUUUGAUGUCCUCCUUCCUCUCCG$_{AA-5'}$ (SEQ ID NO: 2059)

AR-3054 Target: 5'-TGAAACTACAGGAGGAAGGAGAGGCTT-3' (SEQ ID NO: 2464)

5'-GAAACUACAGGAGGAAGGAGAGGCU$^{CA-3'}$ (SEQ ID NO: 4238)
3'-CUUUGAUGUCCUCCUUCCUCUCCGA$_{AG-5'}$ (SEQ ID NO: 2060)

AR-3055 Target: 5'-GAAACTACAGGAGGAAGGAGAGGCTTC-3' (SEQ ID NO: 2465)

TABLE 5-continued

Selected Human Anti-AR 27mer "Blunt/Fray" DsiRNA Agents

5'-CACAUUGAAGGCUAUGAAUGUCAGC$^{AA-3'}$ (SEQ ID NO: 4239)
3'-GUGUAACUUCCGAUACUUACAGUCG$_{G-5'}$ (SEQ ID NO: 2061)

AR-3131 Target: 5'-CACATTGAAGGCTATGAATGTCAGCCC-3' (SEQ ID NO: 2466)

5'-ACAUUGAAGGCUAUGAAUGUCAGCC$^{AC-3'}$ (SEQ ID NO: 4240)
3'-UGUAACUUCCGAUACUUACAGUCGG$_{G U-5'}$ (SEQ ID NO: 2062)

AR-3132 Target: 5'-ACATTGAAGGCTATGAATGTCAGCCCA-3' (SEQ ID NO: 2467)

5'-CAUUGAAGGCUAUGAAUGUCAGCCC$^{CC-3'}$ (SEQ ID NO: 4241)
3'-GUAACUUCCGAUACUUACAGUCGGG$_{U A-5'}$ (SEQ ID NO: 2063)

AR-3133 Target: 5'-CATTGAAGGCTATGAATGTCAGCCCAT-3' (SEQ ID NO: 2468)

5'-AUUGAAGGCUAUGAAUGUCAGCCCA$^{CA-3'}$ (SEQ ID NO: 4242)
3'-UAACUUCCGAUACUUACAGUCGGGU$_{A G-5'}$ (SEQ ID NO: 2064)

AR-3134 Target: 5'-ATTGAAGGCTATGAATGTCAGCCCATC-3' (SEQ ID NO: 2469)

5'-UUGAAGGCUAUGAAUGUCAGCCCAU$^{AC-3'}$ (SEQ ID NO: 4243)
3'-AACUUCCGAUACUUACAGUCGGGUA$_{G A-5'}$ (SEQ ID NO: 2065)

AR-3135 Target: 5'-TTGAAGGCTATGAATGTCAGCCCATCT-3' (SEQ ID NO: 2470)

5'-UGAAGGCUAUGAAUGUCAGCCCAUC$^{CC-3'}$ (SEQ ID NO: 4244)
3'-ACUUCCGAUACUUACAGUCGGGUAG$_{A A-5'}$ (SEQ ID NO: 2066)

AR-3136 Target: 5'-TGAAGGCTATGAATGTCAGCCCATCTT-3' (SEQ ID NO: 2471)

5'-AUGUCCUGGAAGCCAUUGAGCCAGG$^{CA-3'}$ (SEQ ID NO: 4245)
3'-UACAGGACCUUCGGUAACUCGGUCC$_{A C-5'}$ (SEQ ID NO: 2067)

AR-3168 Target: 5'-ATGTCCTGGAAGCCATTGAGCCAGGTG-3' (SEQ ID NO: 2472)

5'-UGUCCUGGAAGCCAUUGAGCCAGGU$^{AC-3'}$ (SEQ ID NO: 4246)
3'-ACAGGACCUUCGGUAACUCGGUCCA$_{C A-5'}$ (SEQ ID NO: 2068)

AR-3169 Target: 5'-TGTCCTGGAAGCCATTGAGCCAGGTGT-3' (SEQ ID NO: 2473)

5'-GUCCUGGAAGCCAUUGAGCCAGGUG$^{CC-3'}$ (SEQ ID NO: 4247)
3'-CAGGACCUUCGGUAACUCGGUCCAC$_{A U-5'}$ (SEQ ID NO: 2069)

AR-3170 Target: 5'-GTCCTGGAAGCCATTGAGCCAGGTGTA-3' (SEQ ID NO: 2474)

5'-UCCUGGAAGCCAUUGAGCCAGGUGU$^{CA-3'}$ (SEQ ID NO: 4248)
3'-AGGACCUUCGGUAACUCGGUCCACA$_{U C-5'}$ (SEQ ID NO: 2070)

AR-3171 Target: 5'-TCCTGGAAGCCATTGAGCCAGGTGTAG-3' (SEQ ID NO: 2475)

5'-CCUGGAAGCCAUUGAGCCAGGUGUA$^{AC-3'}$ (SEQ ID NO: 4249)
3'-GGACCUUCGGUAACUCGGUCCACAU$_{C A-5'}$ (SEQ ID NO: 2071)

AR-3172 Target: 5'-CCTGGAAGCCATTGAGCCAGGTGTAGT-3' (SEQ ID NO: 2476)

5'-ACCAGCCCGACUCCUUUGCAGCCUU$^{AA-3'}$ (SEQ ID NO: 4250)
3'-UGGUCGGGCUGAGGAAACGUCGGAA$_{C G-5'}$ (SEQ ID NO: 2072)

AR-3219 Target: 5'-ACCAGCCCGACTCCTTTGCAGCCTTGC-3' (SEQ ID NO: 2477)

TABLE 5-continued

Selected Human Anti-AR 27mer "Blunt/Fray" DsiRNA Agents

5'-CCGACUCCUUUGCAGCCUUGCUCUC$^{CC-3'}$ (SEQ ID NO: 4251)
3'-GGCUGAGGAAACGUCGGAACGAGAG$_{AU-5'}$ (SEQ ID NO: 2073)

AR-3225 Target: 5'-CCGACTCCTTTGCAGCCTTGCTCTCTA-3' (SEQ ID NO: 2478)

5'-UGCAGCCUUGCUCUCUAGCCUCAAU$^{AC-3'}$ (SEQ ID NO: 4252)
3'-ACGUCGGAACGAGAGAUCGGAGUUA$_{CU-5'}$ (SEQ ID NO: 2074)

AR-3235 Target: 5'-TGCAGCCTTGCTCTCTAGCCTCAATGA-3' (SEQ ID NO: 2479)

5'-ACGUGGUCAAGUGGGCCAAGGCCUU$^{AA-3'}$ (SEQ ID NO: 4253)
3'-UGCACCAGUUCACCCGGUUCCGGAA$_{CG-5'}$ (SEQ ID NO: 2075)

AR-3285 Target: 5'-ACGTGGTCAAGTGGGCCAAGGCCTTGC-3' (SEQ ID NO: 2480)

5'-CGUGGUCAAGUGGGCCAAGGCCUUG$^{AA-3'}$ (SEQ ID NO: 4254)
3'-GCACCAGUUCACCCGGUUCCGGAAC$_{GG-5'}$ (SEQ ID NO: 2076)

AR-3286 Target: 5'-CGTGGTCAAGTGGGCCAAGGCCTTGCC-3' (SEQ ID NO: 2481)

5'-GUGGUCAAGUGGGCCAAGGCCUUGC$^{AC-3'}$ (SEQ ID NO: 4255)
3'-CACCAGUUCACCCGGUUCCGGAACG$_{GA-5'}$ (SEQ ID NO: 2077)

AR-3287 Target: 5'-GTGGTCAAGTGGGCCAAGGCCTTGCCT-3' (SEQ ID NO: 2482)

5'-UGGUCAAGUGGGCCAAGGCCUUGCC$^{CA-3'}$ (SEQ ID NO: 4256)
3'-ACCAGUUCACCCGGUUCCGGAACGG$_{AC-5'}$ (SEQ ID NO: 2078)

AR-3288 Target: 5'-TGGTCAAGTGGGCCAAGGCCTTGCCTG-3' (SEQ ID NO: 2483)

5'-GGUCAAGUGGGCCAAGGCCUUGCCU$^{AA-3'}$ (SEQ ID NO: 4257)
3'-CCAGUUCACCCGGUUCCGGAACGGA$_{CC-5'}$ (SEQ ID NO: 2079)

AR-3289 Target: 5'-GGTCAAGTGGGCCAAGGCCTTGCCTGG-3' (SEQ ID NO: 2484)

5'-GUCAAGUGGGCCAAGGCCUUGCCUG$^{AA-3'}$ (SEQ ID NO: 4258)
3'-CAGUUCACCCGGUUCCGGAACGGAC$_{CG-5'}$ (SEQ ID NO: 2080)

AR-3290 Target: 5'-GTCAAGTGGGCCAAGGCCTTGCCTGGC-3' (SEQ ID NO: 2485)

5'-UCAAGUGGGCCAAGGCCUUGCCUGG$^{AC-3'}$ (SEQ ID NO: 4259)
3'-AGUUCACCCGGUUCCGGAACGGACC$_{GA-5'}$ (SEQ ID NO: 2081)

AR-3291 Target: 5'-TCAAGTGGGCCAAGGCCTTGCCTGGCT-3' (SEQ ID NO: 2486)

5'-CAAGUGGGCCAAGGCCUUGCCUGGC$^{CC-3'}$ (SEQ ID NO: 4260)
3'-GUUCACCCGGUUCCGGAACGGACCG$_{AA-5'}$ (SEQ ID NO: 2082)

AR-3292 Target: 5'-CAAGTGGGCCAAGGCCTTGCCTGGCTT-3' (SEQ ID NO: 2487)

5'-AAGUGGGCCAAGGCCUUGCCUGGCU$^{CA-3'}$ (SEQ ID NO: 4261)
3'-UUCACCCGGUUCCGGAACGGACCGA$_{AG-5'}$ (SEQ ID NO: 2083)

AR-3293 Target: 5'-AAGTGGGCCAAGGCCTTGCCTGGCTTC-3' (SEQ ID NO: 2488)

5'-AGUGGGCCAAGGCCUUGCCUGGCUU$^{AA-3'}$ (SEQ ID NO: 4262)
3'-UCACCCGGUUCCGGAACGGACCGAA$_{GG-5'}$ (SEQ ID NO: 2084)

AR-3294 Target: 5'-AGTGGGCCAAGGCCTTGCCTGGCTTCC-3' (SEQ ID NO: 2489)

TABLE 5-continued

Selected Human Anti-AR 27mer "Blunt/Fray" DsiRNA Agents

5'-GUGGGCCAAGGCCUUGCCUGGCUUC$^{AA\text{-}3'}$ (SEQ ID NO: 4263)
3'-CACCCGGUUCCGGAACGGACCGAAG$_{GC\text{-}5'}$ (SEQ ID NO: 2085)

AR-3295 Target: 5'-GTGGGCCAAGGCCTTGCCTGGCTTCCG-3' (SEQ ID NO: 2490)

5'-UGGGCCAAGGCCUUGCCUGGCUUCC$^{AA\text{-}3'}$ (SEQ ID NO: 4264)
3'-ACCCGGUUCCGGAACGGACCGAAGG$_{CG\text{-}5'}$ (SEQ ID NO: 2086)

AR-3296 Target: 5'-TGGGCCAAGGCCTTGCCTGGCTTCCGC-3' (SEQ ID NO: 2491)

5'-GGGCCAAGGCCUUGCCUGGCUUCCG$^{AC\text{-}3'}$ (SEQ ID NO: 4265)
3'-CCCGGUUCCGGAACGGACCGAAGGC$_{GU\text{-}5'}$ (SEQ ID NO: 2087)

AR-3297 Target: 5'-GGGCCAAGGCCTTGCCTGGCTTCCGCA-3' (SEQ ID NO: 2492)

5'-GGCCAAGGCCUUGCCUGGCUUCCGC$^{CC\text{-}3'}$ (SEQ ID NO: 4266)
3'-CCGGUUCCGGAACGGACCGAAGGCG$_{UU\text{-}5'}$ (SEQ ID NO: 2088)

AR-3298 Target: 5'-GGCCAAGGCCTTGCCTGGCTTCCGCAA-3' (SEQ ID NO: 2493)

5'-GCCAAGGCCUUGCCUGGCUUCCGCA$^{CA\text{-}3'}$ (SEQ ID NO: 4267)
3'-CGGUUCCGGAACGGACCGAAGGCGU$_{UG\text{-}5'}$ (SEQ ID NO: 2089)

AR-3299 Target: 5'-GCCAAGGCCTTGCCTGGCTTCCGCAAC-3' (SEQ ID NO: 2494)

5'-CCAAGGCCUUGCCUGGCUUCCGCAA$^{AC\text{-}3'}$ (SEQ ID NO: 4268)
3'-GGUUCCGGAACGGACCGAAGGCGUU$_{GA\text{-}5'}$ (SEQ ID NO: 2090)

AR-3300 Target: 5'-CCAAGGCCTTGCCTGGCTTCCGCAACT-3' (SEQ ID NO: 2495)

5'-CAAGGCCUUGCCUGGCUUCCGCAAC$^{CC\text{-}3'}$ (SEQ ID NO: 4269)
3'-GUUCCGGAACGGACCGAAGGCGUUG$_{AA\text{-}5'}$ (SEQ ID NO: 2091)

AR-3301 Target: 5'-CAAGGCCTTGCCTGGCTTCCGCAACTT-3' (SEQ ID NO: 2496)

5'-AAGGCCUUGCCUGGCUUCCGCAACU$^{CC\text{-}3'}$ (SEQ ID NO: 4270)
3'-UUCCGGAACGGACCGAAGGCGUUGA$_{AU\text{-}5'}$ (SEQ ID NO: 2092)

AR-3302 Target: 5'-AAGGCCTTGCCTGGCTTCCGCAACTTA-3' (SEQ ID NO: 2497)

5'-AGGCCUUGCCUGGCUUCCGCAACUU$^{CA\text{-}3'}$ (SEQ ID NO: 4271)
3'-UCCGGAACGGACCGAAGGCGUUGAA$_{UG\text{-}5'}$ (SEQ ID NO: 2093)

AR-3303 Target: 5'-AGGCCTTGCCTGGCTTCCGCAACTTAC-3' (SEQ ID NO: 2498)

5'-GGCCUUGCCUGGCUUCCGCAACUUA$^{AC\text{-}3'}$ (SEQ ID NO: 4272)
3'-CCGGAACGGACCGAAGGCGUUGAAU$_{GU\text{-}5'}$ (SEQ ID NO: 2094)

AR-3304 Target: 5'-GGCCTTGCCTGGCTTCCGCAACTTACA-3' (SEQ ID NO: 2499)

5'-GCCUUGCCUGGCUUCCGCAACUUAC$^{CA\text{-}3'}$ (SEQ ID NO: 4273)
3'-CGGAACGGACCGAAGGCGUUGAAUG$_{UG\text{-}5'}$ (SEQ ID NO: 2095)

AR-3305 Target: 5'-GCCTTGCCTGGCTTCCGCAACTTACAC-3' (SEQ ID NO: 2500)

5'-CCUUGCCUGGCUUCCGCAACUUACA$^{AA\text{-}3'}$ (SEQ ID NO: 4274)
3'-GGAACGGACCGAAGGCGUUGAAUGU$_{GC\text{-}5'}$ (SEQ ID NO: 2096)

AR-3306 Target: 5'-CCTTGCCTGGCTTCCGCAACTTACACG-3' (SEQ ID NO: 2501)

TABLE 5-continued

Selected Human Anti-AR 27mer "Blunt/Fray" DsiRNA Agents

5'-CUUGCCUGGCUUCCGCAACUUACAC$^{AC-3'}$ (SEQ ID NO: 4275)
3'-GAACGGACCGAAGGCGUUGAAUGUG$_{CA-5'}$ (SEQ ID NO: 2097)

AR-3307 Target: 5'-CTTGCCTGGCTTCCGCAACTTACACGT-3' (SEQ ID NO: 2502)

5'-CCAAUGUCAACUCCAGGAUGCUCUA$^{AC-3'}$ (SEQ ID NO: 4276)
3'-GGUUACAGUUGAGGUCCUACGAGAU$_{GA-5'}$ (SEQ ID NO: 2098)

AR-3408 Target: 5'-CCAATGTCAACTCCAGGATGCTCTACT-3' (SEQ ID NO: 2503)

5'-CAAUGUCAACUCCAGGAUGCUCUAC$^{CC-3'}$ (SEQ ID NO: 4277)
3'-GUUACAGUUGAGGUCCUACGAGAUG$_{AA-5'}$ (SEQ ID NO: 2099)

AR-3409 Target: 5'-CAATGTCAACTCCAGGATGCTCTACTT-3' (SEQ ID NO: 2504)

5'-AAUGUCAACUCCAGGAUGCUCUACU$^{CA-3'}$ (SEQ ID NO: 4278)
3'-UUACAGUUGAGGUCCUACGAGAUGA$_{AG-5'}$ (SEQ ID NO: 2100)

AR-3410 Target: 5'-AATGTCAACTCCAGGATGCTCTACTTC-3' (SEQ ID NO: 2505)

5'-AUGUCAACUCCAGGAUGCUCUACUU$^{AA-3'}$ (SEQ ID NO: 4279)
3'-UACAGUUGAGGUCCUACGAGAUGAA$_{GC-5'}$ (SEQ ID NO: 2101)

AR-3411 Target: 5'-ATGTCAACTCCAGGATGCTCTACTTCG-3' (SEQ ID NO: 2506)

5'-UGUCAACUCCAGGAUGCUCUACUUC$^{AA-3'}$ (SEQ ID NO: 4280)
3'-ACAGUUGAGGUCCUACGAGAUGAAG$_{CG-5'}$ (SEQ ID NO: 2102)

AR-3412 Target: 5'-TGTCAACTCCAGGATGCTCTACTTCGC-3' (SEQ ID NO: 2507)

5'-GUCAACUCCAGGAUGCUCUACUUCG$^{AA-3'}$ (SEQ ID NO: 4281)
3'-CAGUUGAGGUCCUACGAGAUGAAGC$_{GG-5'}$ (SEQ ID NO: 2103)

AR-3413 Target: 5'-GTCAACTCCAGGATGCTCTACTTCGCC-3' (SEQ ID NO: 2508)

5'-UCAACUCCAGGAUGCUCUACUUCGC$^{AA-3'}$ (SEQ ID NO: 4282)
3'-AGUUGAGGUCCUACGAGAUGAAGCG$_{GG-5'}$ (SEQ ID NO: 2104)

AR-3414 Target: 5'-TCAACTCCAGGATGCTCTACTTCGCCC-3' (SEQ ID NO: 2509)

5'-UCUGGUUUUCAAUGAGUACCGCAUG$^{AC-3'}$ (SEQ ID NO: 4283)
3'-AGACCAAAAGUUACUCAUGGCGUAC$_{GU-5'}$ (SEQ ID NO: 2105)

AR-3445 Target: 5'-TCTGGTTTTCAATGAGTACCGCATGCA-3' (SEQ ID NO: 2510)

5'-CUGGUUUUCAAUGAGUACCGCAUGC$^{CA-3'}$ (SEQ ID NO: 4284)
3'-GACCAAAAGUUACUCAUGGCGUACG$_{UG-5'}$ (SEQ ID NO: 2106)

AR-3446 Target: 5'-CTGGTTTTCAATGAGTACCGCATGCAC-3' (SEQ ID NO: 2511)

5'-UGGUUUUCAAUGAGUACCGCAUGCA$^{AC-3'}$ (SEQ ID NO: 4285)
3'-ACCAAAAGUUACUCAUGGCGUACGU$_{GU-5'}$ (SEQ ID NO: 2107)

AR-3447 Target: 5'-TGGTTTTCAATGAGTACCGCATGCACA-3' (SEQ ID NO: 2512)

5'-GGUUUUCAAUGAGUACCGCAUGCAC$^{CC-3'}$ (SEQ ID NO: 4286)
3'-CCAAAAGUUACUCAUGGCGUACGUG$_{UU-5'}$ (SEQ ID NO: 2108)

AR-3448 Target: 5'-GGTTTTCAATGAGTACCGCATGCACAA-3' (SEQ ID NO: 2513)

TABLE 5-continued

Selected Human Anti-AR 27mer "Blunt/Fray" DsiRNA Agents

5'-GUUUUCAAUGAGUACCGCAUGCACA$^{CA-3'}$ (SEQ ID NO: 4287)
3'-CAAAAGUUACUCAUGGCGUACGUGU$_{UC-5'}$ (SEQ ID NO: 2109)

AR-3449 Target: 5'-GTTTTCAATGAGTACCGCATGCACAAG-3' (SEQ ID NO: 2514)

5'-UUUUCAAUGAGUACCGCAUGCACAA$^{AC-3'}$ (SEQ ID NO: 4288)
3'-AAAAGUUACUCAUGGCGUACGUGUU$_{CA-5'}$ (SEQ ID NO: 2110)

AR-3450 Target: 5'-TTTTCAATGAGTACCGCATGCACAAGT-3' (SEQ ID NO: 2515)

5'-UUUCAAUGAGUACCGCAUGCACAAG$^{CA-3'}$ (SEQ ID NO: 4289)
3'-AAAGUUACUCAUGGCGUACGUGUUC$_{AG-5'}$ (SEQ ID NO: 2111)

AR-3451 Target: 5'-TTTCAATGAGTACCGCATGCACAAGTC-3' (SEQ ID NO: 2516)

5'-UUCAAUGAGUACCGCAUGCACAAGU$^{AA-3'}$ (SEQ ID NO: 4290)
3'-AAGUUACUCAUGGCGUACGUGUUCA$_{G-5'}$ (SEQ ID NO: 2112)

AR-3452 Target: 5'-TTCAATGAGTACCGCATGCACAAGTCC-3' (SEQ ID NO: 2517)

5'-UCAAUGAGUACCGCAUGCACAAGUC$^{AA-3'}$ (SEQ ID NO: 4291)
3'-AGUUACUCAUGGCGUACGUGUUCAG$_{G-5'}$ (SEQ ID NO: 2113)

AR-3453 Target: 5'-TCAATGAGTACCGCATGCACAAGTCCC-3' (SEQ ID NO: 2518)

5'-CAAUGAGUACCGCAUGCACAAGUCC$^{AA-3'}$ (SEQ ID NO: 4292)
3'-GUUACUCAUGGCGUACGUGUUCAGG$_{C-5'}$ (SEQ ID NO: 2114)

AR-3454 Target: 5'-CAATGAGTACCGCATGCACAAGTCCCG-3' (SEQ ID NO: 2519)

5'-AAUGAGUACCGCAUGCACAAGUCCC$^{AA-3'}$ (SEQ ID NO: 4293)
3'-UUACUCAUGGCGUACGUGUUCAGGG$_{C-5'}$ (SEQ ID NO: 2115)

AR-3455 Target: 5'-AATGAGTACCGCATGCACAAGTCCCGG-3' (SEQ ID NO: 2520)

5'-AUGAGUACCGCAUGCACAAGUCCCG$^{AC-3'}$ (SEQ ID NO: 4294)
3'-UACUCAUGGCGUACGUGUUCAGGGC$_{CU-5'}$ (SEQ ID NO: 2116)

AR-3456 Target: 5'-ATGAGTACCGCATGCACAAGTCCCGGA-3' (SEQ ID NO: 2521)

5'-UGAGUACCGCAUGCACAAGUCCCGG$^{CC-3'}$ (SEQ ID NO: 4295)
3'-ACUCAUGGCGUACGUGUUCAGGGCC$_{UA-5'}$ (SEQ ID NO: 2117)

AR-3457 Target: 5'-TGAGTACCGCATGCACAAGTCCCGGAT-3' (SEQ ID NO: 2522)

5'-UCUCUCAAGAGUUUGGAUGGCUCCA$^{CC-3'}$ (SEQ ID NO: 4296)
3'-AGAGAGUUCUCAAACCUACCGAGGU$_{U-5'}$ (SEQ ID NO: 2118)

AR-3513 Target: 5'-TCTCTCAAGAGTTTGGATGGCTCCAAA-3' (SEQ ID NO: 2523)

5'-CUCUCAAGAGUUUGGAUGGCUCCAA$^{CC-3'}$ (SEQ ID NO: 4297)
3'-GAGAGUUCUCAAACCUACCGAGGUU$_{UA-5'}$ (SEQ ID NO: 2119)

AR-3514 Target: 5'-CTCTCAAGAGTTTGGATGGCTCCAAAT-3' (SEQ ID NO: 2524)

5'-UCUCAAGAGUUUGGAUGGCUCCAAA$^{CA-3'}$ (SEQ ID NO: 4298)
3'-AGAGUUCUCAAACCUACCGAGGUUU$_{AG-5'}$ (SEQ ID NO: 2120)

AR-3515 Target: 5'-TCTCAAGAGTTTGGATGGCTCCAAATC-3' (SEQ ID NO: 2525)

TABLE 5-continued

Selected Human Anti-AR 27mer "Blunt/Fray" DsiRNA Agents

5'-CUCAAGAGUUUGGAUGGCUCCAAAU$^{A}$$^{C-3'}$ (SEQ ID NO: 4299)
3'-GAGUUCUCAAACCUACCGAGGUUUA$_{G}$$_{U-5'}$ (SEQ ID NO: 2121)

AR-3516 Target: 5'-CTCAAGAGTTTGGATGGCTCCAAATCA-3' (SEQ ID NO: 2526)

5'-UCAAGAGUUUGGAUGGCUCCAAAUC$^{C}$$^{A-3'}$ (SEQ ID NO: 4300)
3'-AGUUCUCAAACCUACCGAGGUUUAG$_{U}$$_{G-5'}$ (SEQ ID NO: 2122)

AR-3517 Target: 5'-TCAAGAGTTTGGATGGCTCCAAATCAC-3' (SEQ ID NO: 2527)

5'-CAAGAGUUUGGAUGGCUCCAAAUCA$^{A}$$^{A-3'}$ (SEQ ID NO: 4301)
3'-GUUCUCAAACCUACCGAGGUUUAGU$_{G-5'}$ (SEQ ID NO: 2123)

AR-3518 Target: 5'-CAAGAGTTTGGATGGCTCCAAATCACC-3' (SEQ ID NO: 2528)

5'-AAGAGUUUGGAUGGCUCCAAAUCAC$^{A}$$^{A-3'}$ (SEQ ID NO: 4302)
3'-UUCUCAAACCUACCGAGGUUUAGUG$_{G-5'}$ (SEQ ID NO: 2124)

AR-3519 Target: 5'-AAGAGTTTGGATGGCTCCAAATCACCC-3' (SEQ ID NO: 2529)

5'-CCCAGGAAUUCCUGUGCAUGAAAGC$^{C}$$^{A-3'}$ (SEQ ID NO: 4303)
3'-GGGUCCUUAAGGACACGUACUUUCG$_{U}$$_{G-5'}$ (SEQ ID NO: 2125)

AR-3546 Target: 5'-CCCAGGAATTCCTGTGCATGAAAGCAC-3' (SEQ ID NO: 2530)

5'-CCAGGAAUUCCUGUGCAUGAAAGCA$^{A}$$^{C-3'}$ (SEQ ID NO: 4304)
3'-GGUCCUUAAGGACACGUACUUUCGU$_{G}$$_{A-5'}$ (SEQ ID NO: 2126)

AR-3547 Target: 5'-CCAGGAATTCCTGTGCATGAAAGCACT-3' (SEQ ID NO: 2531)

5'-CAGGAAUUCCUGUGCAUGAAAGCAC$^{C}$$^{A-3'}$ (SEQ ID NO: 4305)
3'-GUCCUUAAGGACACGUACUUUCGUG$_{A}$$_{C-5'}$ (SEQ ID NO: 2127)

AR-3548 Target: 5'-CAGGAATTCCTGTGCATGAAAGCACTG-3' (SEQ ID NO: 2532)

5'-AGGAAUUCCUGUGCAUGAAAGCACU$^{A}$$^{A-3'}$ (SEQ ID NO: 4306)
3'-UCCUUAAGGACACGUACUUUCGUGA$_{C}$$_{G-5'}$ (SEQ ID NO: 2128)

AR-3549 Target: 5'-AGGAATTCCTGTGCATGAAAGCACTGC-3' (SEQ ID NO: 2533)

5'-GGAAUUCCUGUGCAUGAAAGCACUG$^{A}$$^{C-3'}$ (SEQ ID NO: 4307)
3'-CCUUAAGGACACGUACUUUCGUGAC$_{G}$$_{A-5'}$ (SEQ ID NO: 2129)

AR-3550 Target: 5'-GGAATTCCTGTGCATGAAAGCACTGCT-3' (SEQ ID NO: 2534)

5'-GAAUUCCUGUGCAUGAAAGCACUGC$^{C}$$^{C-3'}$ (SEQ ID NO: 4308)
3'-CUUAAGGACACGUACUUUCGUGACG$_{A}$$_{U-5'}$ (SEQ ID NO: 2130)

AR-3551 Target: 5'-GAATTCCTGTGCATGAAAGCACTGCTA-3' (SEQ ID NO: 2535)

5'-AAUUCCUGUGCAUGAAAGCACUGCU$^{C}$$^{A-3'}$ (SEQ ID NO: 4309)
3'-UUAAGGACACGUACUUUCGUGACGA$_{U}$$_{G-5'}$ (SEQ ID NO: 2131)

AR-3552 Target: 5'-AATTCCTGTGCATGAAAGCACTGCTAC-3' (SEQ ID NO: 2536)

5'-AUUCCUGUGCAUGAAAGCACUGCUA$^{A}$$^{C-3'}$ (SEQ ID NO: 4310)
3'-UAAGGACACGUACUUUCGUGACGAU$_{G}$$_{A-5'}$ (SEQ ID NO: 2132)

AR-3553 Target: 5'-ATTCCTGTGCATGAAAGCACTGCTACT-3' (SEQ ID NO: 2537)

TABLE 5-continued

Selected Human Anti-AR 27mer "Blunt/Fray" DsiRNA Agents

5'-UUCCUGUGCAUGAAAGCACUGCUAC$^{\text{CA-3'}}$   (SEQ ID NO: 4311)
3'-AAGGACACGUACUUUCGUGACGAUG$_{\text{A}_{\text{G-5'}}}$ (SEQ ID NO: 2133)

AR-3554 Target: 5'-TTCCTGTGCATGAAAGCACTGCTACTC-3' (SEQ ID NO: 2538)

5'-UCCUGUGCAUGAAAGCACUGCUACU$^{\text{AC-3'}}$   (SEQ ID NO: 4312)
3'-AGGACACGUACUUUCGUGACGAUGA$_{\text{G}_{\text{A-5'}}}$ (SEQ ID NO: 2134)

AR-3555 Target: 5'-TCCTGTGCATGAAAGCACTGCTACTCT-3' (SEQ ID NO: 2539)

5'-CCUGUGCAUGAAAGCACUGCUACUC$^{\text{CC-3'}}$   (SEQ ID NO: 4313)
3'-GGACACGUACUUUCGUGACGAUGAG$_{\text{A}_{\text{A-5'}}}$ (SEQ ID NO: 2135)

AR-3556 Target: 5'-CCTGTGCATGAAAGCACTGCTACTCTT-3' (SEQ ID NO: 2540)

5'-UACUCUUCAGCAUUAUUCCAGUGGA$^{\text{CA-3'}}$   (SEQ ID NO: 4314)
3'-AUGAGAAGUCGUAAUAAGGUCACCU$_{\text{A}_{\text{C-5'}}}$ (SEQ ID NO: 2136)

AR-3576 Target: 5'-TACTCTTCAGCATTATTCCAGTGGATG-3' (SEQ ID NO: 2541)

5'-ACUCUUCAGCAUUAUUCCAGUGGAU$^{\text{AA-3'}}$   (SEQ ID NO: 4315)
3'-UGAGAAGUCGUAAUAAGGUCACCUA$_{\text{C}_{\text{C-5'}}}$ (SEQ ID NO: 2137)

AR-3577 Target: 5'-ACTCTTCAGCATTATTCCAGTGGATGG-3' (SEQ ID NO: 2542)

5'-CUCUUCAGCAUUAUUCCAGUGGAUG$^{\text{AA-3'}}$   (SEQ ID NO: 4316)
3'-GAGAAGUCGUAAUAAGGUCACCUAC$_{\text{C}_{\text{C-5'}}}$ (SEQ ID NO: 2138)

AR-3578 Target: 5'-CTCTTCAGCATTATTCCAGTGGATGGG-3' (SEQ ID NO: 2543)

5'-UCUUCAGCAUUAUUCCAGUGGAUGG$^{\text{AA-3'}}$   (SEQ ID NO: 4317)
3'-AGAAGUCGUAAUAAGGUCACCUACC$_{\text{C}_{\text{G-5'}}}$ (SEQ ID NO: 2139)

AR-3579 Target: 5'-TCTTCAGCATTATTCCAGTGGATGGGC-3' (SEQ ID NO: 2544)

5'-CUUCAGCAUUAUUCCAGUGGAUGGG$^{\text{AC-3'}}$   (SEQ ID NO: 4318)
3'-GAAGUCGUAAUAAGGUCACCUACCC$_{\text{G}_{\text{A-5'}}}$ (SEQ ID NO: 2140)

AR-3580 Target: 5'-CTTCAGCATTATTCCAGTGGATGGGCT-3' (SEQ ID NO: 2545)

5'-UUCAGCAUUAUUCCAGUGGAUGGGC$^{\text{CA-3'}}$   (SEQ ID NO: 4319)
3'-AAGUCGUAAUAAGGUCACCUACCCG$_{\text{A}_{\text{C-5'}}}$ (SEQ ID NO: 2141)

AR-3581 Target: 5'-TTCAGCATTATTCCAGTGGATGGGCTG-3' (SEQ ID NO: 2546)

5'-UCAGCAUUAUUCCAGUGGAUGGGCU$^{\text{AC-3'}}$   (SEQ ID NO: 4320)
3'-AGUCGUAAUAAGGUCACCUACCCGA$_{\text{C}_{\text{U-5'}}}$ (SEQ ID NO: 2142)

AR-3582 Target: 5'-TCAGCATTATTCCAGTGGATGGGCTGA-3' (SEQ ID NO: 2547)

5'-CAGCAUUAUUCCAGUGGAUGGGCUG$^{\text{CC-3'}}$   (SEQ ID NO: 4321)
3'-GUCGUAAUAAGGUCACCUACCCGAC$_{\text{U}_{\text{U-5'}}}$ (SEQ ID NO: 2143)

AR-3583 Target: 5'-CAGCATTATTCCAGTGGATGGGCTGAA-3' (SEQ ID NO: 2548)

5'-AGCAUUAUUCCAGUGGAUGGGCUGA$^{\text{CC-3'}}$   (SEQ ID NO: 4322)
3'-UCGUAAUAAGGUCACCUACCCGACU$_{\text{U}_{\text{U-5'}}}$ (SEQ ID NO: 2144)

AR-3584 Target: 5'-AGCATTATTCCAGTGGATGGGCTGAAA-3' (SEQ ID NO: 2549)

TABLE 5-continued

Selected Human Anti-AR 27mer "Blunt/Fray" DsiRNA Agents

5'-GCAUUAUUCCAGUGGAUGGGCUGAA<sup>CC</sup>-3' (SEQ ID NO: 4323)
3'-CGUAAUAAGGUCACCUACCCGACUU<sub>U</sub>U-5' (SEQ ID NO: 2145)

AR-3585 Target: 5'-GCATTATTCCAGTGGATGGGCTGAAAA-3' (SEQ ID NO: 2550)

5'-CAUUAUUCCAGUGGAUGGGCUGAAA<sup>CC</sup>-3' (SEQ ID NO: 4324)
3'-GUAAUAAGGUCACCUACCCGACUUU<sub>U</sub>U-5' (SEQ ID NO: 2146)

AR-3586 Target: 5'-CATTATTCCAGTGGATGGGCTGAAAAA-3' (SEQ ID NO: 2551)

5'-AUUAUUCCAGUGGAUGGGCUGAAAA<sup>CC</sup>-3' (SEQ ID NO: 4325)
3'-UAAUAAGGUCACCUACCCGACUUUU<sub>A</sub>U-5' (SEQ ID NO: 2147)

AR-3587 Target: 5'-ATTATTCCAGTGGATGGGCTGAAAAAT-3' (SEQ ID NO: 2552)

5'-UUAUUCCAGUGGAUGGGCUGAAAAA<sup>CA</sup>-3' (SEQ ID NO: 4326)
3'-AAUAAGGUCACCUACCCGACUUUUU<sub>A</sub>G-5' (SEQ ID NO: 2148)

AR-3588 Target: 5'-TTATTCCAGTGGATGGGCTGAAAAATC-3' (SEQ ID NO: 2553)

5'-UAUUCCAGUGGAUGGGCUGAAAAAU<sup>AC</sup>-3' (SEQ ID NO: 4327)
3'-AUAAGGUCACCUACCCGACUUUUUA<sub>G</sub>U-5' (SEQ ID NO: 2149)

AR-3589 Target: 5'-TATTCCAGTGGATGGGCTGAAAAATCA-3' (SEQ ID NO: 2554)

5'-AUUCCAGUGGAUGGGCUGAAAAAUC<sup>CC</sup>-3' (SEQ ID NO: 4328)
3'-UAAGGUCACCUACCCGACUUUUUAG<sub>U</sub>U-5' (SEQ ID NO: 2150)

AR-3590 Target: 5'-ATTCCAGTGGATGGGCTGAAAAATCAA-3' (SEQ ID NO: 2555)

5'-UUCCAGUGGAUGGGCUGAAAAAUCA<sup>CC</sup>-3' (SEQ ID NO: 4329)
3'-AAGGUCACCUACCCGACUUUUUAGU<sub>U</sub>U-5' (SEQ ID NO: 2151)

AR-3591 Target: 5'-TTCCAGTGGATGGGCTGAAAAATCAAA-3' (SEQ ID NO: 2556)

5'-UCCAGUGGAUGGGCUGAAAAAUCAA<sup>CC</sup>-3' (SEQ ID NO: 4330)
3'-AGGUCACCUACCCGACUUUUUAGUU<sub>U</sub>U-5' (SEQ ID NO: 2152)

AR-3592 Target: 5'-TCCAGTGGATGGGCTGAAAAATCAAAA-3' (SEQ ID NO: 2557)

5'-CCAGUGGAUGGGCUGAAAAAUCAAA<sup>CC</sup>-3' (SEQ ID NO: 4331)
3'-GGUCACCUACCCGACUUUUUAGUUU<sub>U</sub>U-5' (SEQ ID NO: 2153)

AR-3593 Target: 5'-CCAGTGGATGGGCTGAAAAATCAAAAA-3' (SEQ ID NO: 2558)

5'-CAGUGGAUGGGCUGAAAAAUCAAAA<sup>CC</sup>-3' (SEQ ID NO: 4332)
3'-GUCACCUACCCGACUUUUUAGUUUU<sub>A</sub>U-5' (SEQ ID NO: 2154)

AR-3594 Target: 5'-CAGTGGATGGGCTGAAAAATCAAAAT-3' (SEQ ID NO: 2559)

5'-AGUGGAUGGGCUGAAAAAUCAAAAA<sup>CC</sup>-3' (SEQ ID NO: 4333)
3'-UCACCUACCCGACUUUUUAGUUUUU<sub>A</sub>A-5' (SEQ ID NO: 2155)

AR-3595 Target: 5'-AGTGGATGGGCTGAAAAATCAAAATT-3' (SEQ ID NO: 2560)

5'-GUGGAUGGGCUGAAAAAUCAAAAAU<sup>CA</sup>-3' (SEQ ID NO: 4334)
3'-CACCUACCCGACUUUUUAGUUUUUA<sub>A</sub>G-5' (SEQ ID NO: 2156)

AR-3596 Target: 5'-GTGGATGGGCTGAAAAATCAAAATTC-3' (SEQ ID NO: 2561)

TABLE 5-continued

Selected Human Anti-AR 27mer "Blunt/Fray" DsiRNA Agents

5'-UGGAUGGGCUGAAAAAUCAAAAAUU$^{AC-3'}$ (SEQ ID NO: 4335)
3'-ACCUACCCGACUUUUUAGUUUUUAA$_{GA-5'}$ (SEQ ID NO: 2157)

AR-3597 Target: 5'-TGGATGGGCTGAAAAATCAAAAATTCT-3' (SEQ ID NO: 2562)

5'-GGAUGGGCUGAAAAAUCAAAAAUUC$^{CC-3'}$ (SEQ ID NO: 4336)
3'-CCUACCCGACUUUUUAGUUUUUAAG$_{AA-5'}$ (SEQ ID NO: 2158)

AR-3598 Target: 5'-GGATGGGCTGAAAAATCAAAAATTCTT-3' (SEQ ID NO: 2563)

5'-GAUGGGCUGAAAAAUCAAAAAUUCU$^{CC-3'}$ (SEQ ID NO: 4337)
3'-CUACCCGACUUUUUAGUUUUUAAGA$_{AA-5'}$ (SEQ ID NO: 2159)

AR-3599 Target: 5'-GATGGGCTGAAAAATCAAAAATTCTTT-3' (SEQ ID NO: 2564)

5'-AUGGGCUGAAAAAUCAAAAAUUCUU$^{CA-3'}$ (SEQ ID NO: 4338)
3'-UACCCGACUUUUUAGUUUUUAAGAA$_{AC-5'}$ (SEQ ID NO: 2160)

AR-3600 Target: 5'-ATGGGCTGAAAAATCAAAAATTCTTTG-3' (SEQ ID NO: 2565)

5'-UGGGCUGAAAAAUCAAAAAUUCUUU$^{AC-3'}$ (SEQ ID NO: 4339)
3'-ACCCGACUUUUUAGUUUUUAAGAAA$_{CU-5'}$ (SEQ ID NO: 2161)

AR-3601 Target: 5'-TGGGCTGAAAAATCAAAAATTCTTTGA-3' (SEQ ID NO: 2566)

5'-GGGCUGAAAAAUCAAAAAUUCUUUG$^{CC-3'}$ (SEQ ID NO: 4340)
3'-CCCGACUUUUUAGUUUUUAAGAAAC$_{UA-5'}$ (SEQ ID NO: 2162)

AR-3602 Target: 5'-GGGCTGAAAAATCAAAAATTCTTTGAT-3' (SEQ ID NO: 2567)

5'-GGCUGAAAAAUCAAAAAUUCUUUGA$^{CA-3'}$ (SEQ ID NO: 4341)
3'-CCGACUUUUUAGUUUUUAAGAAACU$_{AC-5'}$ (SEQ ID NO: 2163)

AR-3603 Target: 5'-GGCTGAAAAATCAAAAATTCTTTGATG-3' (SEQ ID NO: 2568)

5'-GCUGAAAAAUCAAAAAUUCUUUGAU$^{AC-3'}$ (SEQ ID NO: 4342)
3'-CGACUUUUUAGUUUUUAAGAAACUA$_{CU-5'}$ (SEQ ID NO: 2164)

AR-3604 Target: 5'-GCTGAAAAATCAAAAATTCTTTGATGA-3' (SEQ ID NO: 2569)

5'-CUGAAAAAUCAAAAAUUCUUUGAUG$^{CC-3'}$ (SEQ ID NO: 4343)
3'-GACUUUUUAGUUUUUAAGAAACUAC$_{UU-5'}$ (SEQ ID NO: 2165)

AR-3605 Target: 5'-CTGAAAAATCAAAAATTCTTTGATGAA-3' (SEQ ID NO: 2570)

5'-UGAAAAAUCAAAAAUUCUUUGAUGA$^{CA-5'}$ (SEQ ID NO: 4344)
3'-ACUUUUUAGUUUUUAAGAAACUACU$_{UG-5'}$ (SEQ ID NO: 2166)

AR-3606 Target: 5'-TGAAAAATCAAAAATTCTTTGATGAAC-3' (SEQ ID NO: 2571)

5'-AAAAAUCAAAAAUUCUUUGAUGAAC$^{CC-3'}$ (SEQ ID NO: 4345)
3'-UUUUUAGUUUUUAAGAAACUACUUG$_{AA-5'}$ (SEQ ID NO: 2167)

AR-3608 Target: 5'-AAAAATCAAAAATTCTTTGATGAACTT-3' (SEQ ID NO: 2572)

5'-AAAAUCAAAAAUUCUUUGAUGAACU$^{CA-3'}$ (SEQ ID NO: 4346)
3'-UUUUAGUUUUUAAGAAACUACUUGA$_{AG-5'}$ (SEQ ID NO: 2168)

AR-3609 Target: 5'-AAAATCAAAAATTCTTTGATGAACTTC-3' (SEQ ID NO: 2573)

TABLE 5-continued

Selected Human Anti-AR 27mer "Blunt/Fray" DsiRNA Agents

5'-AAAUCAAAAAUUCUUUGAUGAACUU$^{AA-3'}$ (SEQ ID NO: 4347)
3'-UUUAGUUUUUAAGAAACUACUUGAA$_{GC-5'}$ (SEQ ID NO: 2169)

AR-3610 Target: 5'-AAATCAAAAATTCTTTGATGAACTTCG-3' (SEQ ID NO: 2574)

5'-AAUCAAAAAUUCUUUGAUGAACUUC$^{AC-3'}$ (SEQ ID NO: 4348)
3'-UUAGUUUUUAAGAAACUACUUGAAG$_{CU-5'}$ (SEQ ID NO: 2170)

AR-3611 Target: 5'-AATCAAAAATTCTTTGATGAACTTCGA-3' (SEQ ID NO: 2575)

5'-AUCAAAAAUUCUUUGAUGAACUUCG$^{CC-3'}$ (SEQ ID NO: 4349)
3'-UAGUUUUUAAGAAACUACUUGAAGC$_{UU-5'}$ (SEQ ID NO: 2171)

AR-3612 Target: 5'-ATCAAAAATTCTTTGATGAACTTCGAA-3' (SEQ ID NO: 2576)

5'-UCAAAAAUUCUUUGAUGAACUUCGA$^{CC-3'}$ (SEQ ID NO: 4350)
3'-AGUUUUUAAGAAACUACUUGAAGCU$_{UA-5'}$ (SEQ ID NO: 2172)

AR-3613 Target: 5'-TCAAAAATTCTTTGATGAACTTCGAAT-3' (SEQ ID NO: 2577)

5'-CAAAAAUUCUUUGAUGAACUUCGAA$^{CA-3'}$ (SEQ ID NO: 4351)
3'-GUUUUUAAGAAACUACUUGAAGCUU$_{AC-5'}$ (SEQ ID NO: 2173)

AR-3614 Target: 5'-CAAAAATTCTTTGATGAACTTCGAATG-3' (SEQ ID NO: 2578)

5'-AAAAAUUCUUUGAUGAACUUCGAAU$^{AC-3'}$ (SEQ ID NO: 4352)
3'-UUUUUAAGAAACUACUUGAAGCUUA$_{CU-5'}$ (SEQ ID NO: 2174)

AR-3615 Target: 5'-AAAAATTCTTTGATGAACTTCGAATGA-3' (SEQ ID NO: 2579)

5'-AAAAUUCUUUGAUGAACUUCGAAUG$^{CC-3'}$ (SEQ ID NO: 4353)
3'-UUUUAAGAAACUACUUGAAGCUUAC$_{UU-5'}$ (SEQ ID NO: 2175)

AR-3616 Target: 5'-AAAATTCTTTGATGAACTTCGAATGAA-3' (SEQ ID NO: 2580)

5'-AAAUUCUUUGAUGAACUUCGAAUGA$^{CA-5'}$ (SEQ ID NO: 4354)
3'-UUUAAGAAACUACUUGAAGCUUACU$_{UG-5'}$ (SEQ ID NO: 2176)

AR-3617 Target: 5'-AAATTCTTTGATGAACTTCGAATGAAC-3' (SEQ ID NO: 2581)

5'-AAUUCUUUGAUGAACUUCGAAUGAA$^{AC-3'}$ (SEQ ID NO: 4355)
3'-UUAAGAAACUACUUGAAGCUUACUU$_{GA-5'}$ (SEQ ID NO: 2177)

AR-3618 Target: 5'-AATTCTTTGATGAACTTCGAATGAACT-3' (SEQ ID NO: 2582)

5'-AUUCUUUGAUGAACUUCGAAUGAAC$^{CC-3'}$ (SEQ ID NO: 4356)
3'-UAAGAAACUACUUGAAGCUUACUUG$_{AU-5'}$ (SEQ ID NO: 2178)

AR-3619 Target: 5'-ATTCTTTGATGAACTTCGAATGAACTA-3' (SEQ ID NO: 2583)

5'-UUCUUUGAUGAACUUCGAAUGAACU$^{CA-3'}$ (SEQ ID NO: 4357)
3'-AAGAAACUACUUGAAGCUUACUUGA$_{UG-5'}$ (SEQ ID NO: 2179)

AR-3620 Target: 5'-TTCTTTGATGAACTTCGAATGAACTAC-3' (SEQ ID NO: 2584)

5'-UCUUUGAUGAACUUCGAAUGAACUA$^{AC-3'}$ (SEQ ID NO: 4358)
3'-AGAAACUACUUGAAGCUUACUUGAU$_{GU-5'}$ (SEQ ID NO: 2180)

AR-3621 Target: 5'-TCTTTGATGAACTTCGAATGAACTACA-3' (SEQ ID NO: 2585)

TABLE 5-continued

Selected Human Anti-AR 27mer "Blunt/Fray" DsiRNA Agents

```
5'-CUUUGAUGAACUUCGAAUGAACUAC^CC-3'      (SEQ ID NO: 4359)
3'-GAAACUACUUGAAGCUUACUUGAUG_UA-5'      (SEQ ID NO: 2181)
```

AR-3622 Target: 5'-CTTTGATGAACTTCGAATGAACTACAT-3' (SEQ ID NO: 2586)

```
5'-UUUGAUGAACUUCGAAUGAACUACA^CA-3'      (SEQ ID NO: 4360)
3'-AAACUACUUGAAGCUUACUUGAUGU_AG-5'      (SEQ ID NO: 2182)
```

AR-3623 Target: 5'-TTTGATGAACTTCGAATGAACTACATC-3' (SEQ ID NO: 2587)

```
5'-UUGAUGAACUUCGAAUGAACUACAU^AC-3'      (SEQ ID NO: 4361)
3'-AACUACUUGAAGCUUACUUGAUGUA_GU-5'      (SEQ ID NO: 2183)
```

AR-3624 Target: 5'-TTGATGAACTTCGAATGAACTACATCA-3' (SEQ ID NO: 2588)

```
5'-UGAUGAACUUCGAAUGAACUACAUC^CC-3'      (SEQ ID NO: 4362)
3'-ACUACUUGAAGCUUACUUGAUGUAG_UU-5'      (SEQ ID NO: 2184)
```

AR-3625 Target: 5'-TGATGAACTTCGAATGAACTACATCAA-3' (SEQ ID NO: 2589)

```
5'-GAUGAACUUCGAAUGAACUACAUCA^CA-3'      (SEQ ID NO: 4363)
3'-CUACUUGAAGCUUACUUGAUGUAGU_UC-5'      (SEQ ID NO: 2185)
```

AR-3626 Target: 5'-GATGAACTTCGAATGAACTACATCAAG-3' (SEQ ID NO: 2590)

```
5'-AUGAACUUCGAAUGAACUACAUCAA^AA-3'      (SEQ ID NO: 4364)
3'-UACUUGAAGCUUACUUGAUGUAGUU_CC-5'      (SEQ ID NO: 2186)
```

AR-3627 Target: 5'-ATGAACTTCGAATGAACTACATCAAGG-3' (SEQ ID NO: 2591)

```
5'-UGAACUUCGAAUGAACUACAUCAAG^AC-3'      (SEQ ID NO: 4365)
3'-ACUUGAAGCUUACUUGAUGUAGUUC_CU-5'      (SEQ ID NO: 2187)
```

AR-3628 Target: 5'-TGAACTTCGAATGAACTACATCAAGGA-3' (SEQ ID NO: 2592)

```
5'-GAACUUCGAAUGAACUACAUCAAGG^CC-3'      (SEQ ID NO: 4366)
3'-CUUGAAGCUUACUUGAUGUAGUUCC_UU-5'      (SEQ ID NO: 2188)
```

AR-3629 Target: 5'-GAACTTCGAATGAACTACATCAAGGAA-3' (SEQ ID NO: 2593)

```
5'-AACUUCGAAUGAACUACAUCAAGGA^CA-3'      (SEQ ID NO: 4367)
3'-UUGAAGCUUACUUGAUGUAGUUCCU_UG-5'      (SEQ ID NO: 2189)
```

AR-3630 Target: 5'-AACTTCGAATGAACTACATCAAGGAAC-3' (SEQ ID NO: 2594)

```
5'-ACUUCGAAUGAACUACAUCAAGGAA^AC-3'      (SEQ ID NO: 4368)
3'-UGAAGCUUACUUGAUGUAGUUCCUU_GA-5'      (SEQ ID NO: 2190)
```

AR-3631 Target: 5'-ACTTCGAATGAACTACATCAAGGAACT-3' (SEQ ID NO: 2595)

```
5'-CUUCGAAUGAACUACAUCAAGGAAC^CA-3'      (SEQ ID NO: 4369)
3'-GAAGCUUACUUGAUGUAGUUCCUUG_AG-5'      (SEQ ID NO: 2191)
```

AR-3632 Target: 5'-CTTCGAATGAACTACATCAAGGAACTC-3' (SEQ ID NO: 2596)

```
5'-UUCGAAUGAACUACAUCAAGGAACU^AA-3'      (SEQ ID NO: 4370)
3'-AAGCUUACUUGAUGUAGUUCCUUGA_GC-5'      (SEQ ID NO: 2192)
```

AR-3633 Target: 5'-TTCGAATGAACTACATCAAGGAACTCG-3' (SEQ ID NO: 2597)

TABLE 5-continued

Selected Human Anti-AR 27mer "Blunt/Fray" DsiRNA Agents

5'-UCGAAUGAACUACAUCAAGGAACUC$^{AC-3'}$ (SEQ ID NO: 4371)
3'-AGCUUACUUGAUGUAGUUCCUUGAG$_{CU-5'}$ (SEQ ID NO: 2193)

AR-3634 Target: 5'-TCGAATGAACTACATCAAGGAACTCGA-3' (SEQ ID NO: 2598)

5'-CGAAUGAACUACAUCAAGGAACUCG$^{CC-3'}$ (SEQ ID NO: 4372)
3'-GCUUACUUGAUGUAGUUCCUUGAGC$_{UA-5'}$ (SEQ ID NO: 2194)

AR-3635 Target: 5'-CGAATGAACTACATCAAGGAACTCGAT-3' (SEQ ID NO: 2599)

5'-GAAUGAACUACAUCAAGGAACUCGA$^{CA-3'}$ (SEQ ID NO: 4373)
3'-CUUACUUGAUGUAGUUCCUUGAGCU$_{AG-5'}$ (SEQ ID NO: 2195)

AR-3636 Target: 5'-GAATGAACTACATCAAGGAACTCGATC-3' (SEQ ID NO: 2600)

5'-AAUGAACUACAUCAAGGAACUCGAU$^{AA-3'}$ (SEQ ID NO: 4374)
3'-UUACUUGAUGUAGUUCCUUGAGCUA$_{GC-5'}$ (SEQ ID NO: 2196)

AR-3637 Target: 5'-AATGAACTACATCAAGGAACTCGATCG-3 (SEQ ID NO: 2601)

5'-AUGAACUACAUCAAGGAACUCGAUC$^{AC-3'}$ (SEQ ID NO: 4375)
3'-UACUUGAUGUAGUUCCUUGAGCUAG$_{CA-5'}$ (SEQ ID NO: 2197)

AR-3638 Target: 5'-ATGAACTACATCAAGGAACTCGATCGT-3' (SEQ ID NO: 2602)

5'-UGAACUACAUCAAGGAACUCGAUCG$^{CC-3'}$ (SEQ ID NO: 4376)
3'-ACUUGAUGUAGUUCCUUGAGCUAGC$_{AU-5'}$ (SEQ ID NO: 2198)

AR-3639 Target: 5'-TGAACTACATCAAGGAACTCGATCGTA-3' (SEQ ID NO: 2603)

5'-GAACUACAUCAAGGAACUCGAUCGU$^{CC-3'}$ (SEQ ID NO: 4377)
3'-CUUGAUGUAGUUCCUUGAGCUAGCA$_{UA-5'}$ (SEQ ID NO: 2199)

AR-3640 Target: 5'-GAACTACATCAAGGAACTCGATCGTAT-3' (SEQ ID NO: 2604)

5'-AACUACAUCAAGGAACUCGAUCGUA$^{CA-3'}$ (SEQ ID NO: 4378)
3'-UUGAUGUAGUUCCUUGAGCUAGCAU$_{AG-5'}$ (SEQ ID NO: 2200)

AR-3641 Target: 5'-AACTACATCAAGGAACTCGATCGTATC-3' (SEQ ID NO: 2605)

5'-ACUACAUCAAGGAACUCGAUCGUAU$^{AC-3'}$ (SEQ ID NO: 4379)
3'-UGAUGUAGUUCCUUGAGCUAGCAUA$_{GU-5'}$ (SEQ ID NO: 2201)

AR-3642 Target: 5'-ACTACATCAAGGAACTCGATCGTATCA-3' (SEQ ID NO: 2606)

5'-CUACAUCAAGGAACUCGAUCGUAUC$^{CC-3'}$ (SEQ ID NO: 4380)
3'-GAUGUAGUUCCUUGAGCUAGCAUAG$_{UA-5'}$ (SEQ ID NO: 2202)

AR-3643 Target: 5'-CTACATCAAGGAACTCGATCGTATCAT-3' (SEQ ID NO: 2607)

5'-GUAUCAUUGCAUGCAAAAGAAAAAA$^{CA-3'}$ (SEQ ID NO: 4381)
3'-CAUAGUAACGUACGUUUUCUUUUUU$_{AG-5'}$ (SEQ ID NO: 2203)

AR-3663 Target: 5'-GTATCATTGCATGCAAAAGAAAAATC-3' (SEQ ID NO: 2608)

5'-UAUCAUUGCAUGCAAAAGAAAAAAU$^{AA-3'}$ (SEQ ID NO: 4382)
3'-AUAGUAACGUACGUUUUCUUUUUUA$_{GG-5'}$ (SEQ ID NO: 2204)

AR-3664 Target: 5'-TATCATTGCATGCAAAAGAAAAATCC-3' (SEQ ID NO: 2609)

TABLE 5-continued

Selected Human Anti-AR 27mer "Blunt/Fray" DsiRNA Agents

5'-AAAAUCCCACAUCCUGCUCAAGACG$^{AC-3'}$ (SEQ ID NO: 4383)
3'-UUUUAGGGUGUAGGACGAGUUCUGC$_{GA-5'}$ (SEQ ID NO: 2205)

AR-3684 Target: 5'-AAAATCCCACATCCTGCTCAAGACGCT-3' (SEQ ID NO: 2610)

5'-AAAUCCCACAUCCUGCUCAAGACGC$^{CC-3'}$ (SEQ ID NO: 4384)
3'-UUUAGGGUGUAGGACGAGUUCUGCG$_{A-5'}$ (SEQ ID NO: 2206)

AR-3685 Target: 5'-AAATCCCACATCCTGCTCAAGACGCTT-3' (SEQ ID NO: 2611)

5'-GACGCUUCUACCAGCUCACCAAGCU$^{AA-3'}$ (SEQ ID NO: 4385)
3'-CUGCGAAGAUGGUCGAGUGGUUCGA$_{GG-5'}$ (SEQ ID NO: 2207)

AR-3705 Target: 5'-GACGCTTCTACCAGCTCACCAAGCTCC-3' (SEQ ID NO: 2612)

5'-ACGCUUCUACCAGCUCACCAAGCUC$^{AC-3'}$ (SEQ ID NO: 4386)
3'-UGCGAAGAUGGUCGAGUGGUUCGAG$_{GA-5'}$ (SEQ ID NO: 2208)

AR-3706 Target: 5'-ACGCTTCTACCAGCTCACCAAGCTCCT-3' (SEQ ID NO: 2613)

5'-CGCUUCUACCAGCUCACCAAGCUCC$^{CA-3'}$ (SEQ ID NO: 4387)
3'-GCGAAGAUGGUCGAGUGGUUCGAGG$_{AC-5'}$ (SEQ ID NO: 2209)

AR-3707 Target: 5'-CGCTTCTACCAGCTCACCAAGCTCCTG-3' (SEQ ID NO: 2614)

5'-GCUUCUACCAGCUCACCAAGCUCCU$^{AA-3'}$ (SEQ ID NO: 4388)
3'-CGAAGAUGGUCGAGUGGUUCGAGGA$_{CC-5'}$ (SEQ ID NO: 2210)

AR-3708 Target: 5'-GCTTCTACCAGCTCACCAAGCTCCTGG-3' (SEQ ID NO: 2615)

5'-CUUCUACCAGCUCACCAAGCUCCUG$^{AC-3'}$ (SEQ ID NO: 4389)
3'-GAAGAUGGUCGAGUGGUUCGAGGAC$_{CU-5'}$ (SEQ ID NO: 2211)

AR-3709 Target: 5'-CTTCTACCAGCTCACCAAGCTCCTGGA-3' (SEQ ID NO: 2616)

5'-UUCUACCAGCUCACCAAGCUCCUGG$^{CA-3'}$ (SEQ ID NO: 4390)
3'-AAGAUGGUCGAGUGGUUCGAGGACC$_{UG-5'}$ (SEQ ID NO: 2212)

AR-3710 Target: 5'-TTCTACCAGCTCACCAAGCTCCTGGAC-3' (SEQ ID NO: 2617)

5'-UCUACCAGCUCACCAAGCUCCUGGA$^{AC-3'}$ (SEQ ID NO: 4391)
3'-AGAUGGUCGAGUGGUUCGAGGACCU$_{GA-5'}$ (SEQ ID NO: 2213)

AR-3711 Target: 5'-TCTACCAGCTCACCAAGCTCCTGGACT-3' (SEQ ID NO: 2618)

5'-CUACCAGCUCACCAAGCUCCUGGAC$^{CA-3'}$ (SEQ ID NO: 4392)
3'-GAUGGUCGAGUGGUUCGAGGACCUG$_{AG-5'}$ (SEQ ID NO: 2214)

AR-3712 Target: 5'-CTACCAGCTCACCAAGCTCCTGGACTC-3' (SEQ ID NO: 2619)

5'-UACCAGCUCACCAAGCUCCUGGACU$^{AA-3'}$ (SEQ ID NO: 4393)
3'-AUGGUCGAGUGGUUCGAGGACCUGA$_{GG-5'}$ (SEQ ID NO: 2215)

AR-3713 Target: 5'-TACCAGCTCACCAAGCTCCTGGACTCC-3' (SEQ ID NO: 2620)

5'-ACCAGCUCACCAAGCUCCUGGACUC$^{AA-3'}$ (SEQ ID NO: 4394)
3'-UGGUCGAGUGGUUCGAGGACCUGAG$_{GC-5'}$ (SEQ ID NO: 2216)

AR-3714 Target: 5'-ACCAGCTCACCAAGCTCCTGGACTCCG-3' (SEQ ID NO: 2621)

TABLE 5-continued

Selected Human Anti-AR 27mer "Blunt/Fray" DsiRNA Agents

5'-CCAGCUCACCAAGCUCCUGGACUCC$^{AC}$-3' (SEQ ID NO: 4395)
3'-GGUCGAGUGGUUCGAGGACCUGAGG$_{CA}$-5' (SEQ ID NO: 2217)

AR-3715 Target: 5'-CCAGCTCACCAAGCTCCTGGACTCCGT-3' (SEQ ID NO: 2622)

5'-AGCUCACCAAGCUCCUGGACUCCGU$^{AA}$-3' (SEQ ID NO: 4396)
3'-UCGAGUGGUUCGAGGACCUGAGGCA$_{CG}$-5' (SEQ ID NO: 2218)

AR-3717 Target: 5'-AGCTCACCAAGCTCCTGGACTCCGTGC-3' (SEQ ID NO: 2623)

5'-AGCUCCUGGACUCCGUGCAGCCUAU$^{CA}$-3' (SEQ ID NO: 4397)
3'-UCGAGGACCUGAGGCACGUCGGAUA$_{AC}$-5' (SEQ ID NO: 2219)

AR-3726 Target: 5'-AGCTCCTGGACTCCGTGCAGCCTATTG-3' (SEQ ID NO: 2624)

5'-UCCGUGCAGCCUAUUGCGAGAGAGC$^{CA}$-3' (SEQ ID NO: 4398)
3'-AGGCACGUCGGAUAACGCUCUCUCG$_{AC}$-5' (SEQ ID NO: 2220)

AR-3737 Target: 5'-TCCGTGCAGCCTATTGCGAGAGAGCTG-3' (SEQ ID NO: 2625)

5'-CGAGAGAGCUGCAUCAGUUCACUUU$^{CA}$-3' (SEQ ID NO: 4399)
3'-GCUCUCUCGACGUAGUCAAGUGAAA$_{AC}$-5' (SEQ ID NO: 2221)

AR-3753 Target: 5'-CGAGAGAGCTGCATCAGTTCACTTTTG-3' (SEQ ID NO: 2626)

5'-GAGAGAGCUGCAUCAGUUCACUUUU$^{AC}$-3' (SEQ ID NO: 4400)
3'-CUCUCUCGACGUAGUCAAGUGAAAA$_{CU}$-5' (SEQ ID NO: 2222)

AR-3754 Target: 5'-GAGAGAGCTGCATCAGTTCACTTTTGA-3' (SEQ ID NO: 2627)

5'-AGAGAGCUGCAUCAGUUCACUUUUG$^{CA}$-3' (SEQ ID NO: 4401)
3'-UCUCUCGACGUAGUCAAGUGAAAAC$_{UG}$-5' (SEQ ID NO: 2223)

AR-3755 Target: 5'-AGAGAGCTGCATCAGTTCACTTTTGAC-3' (SEQ ID NO: 2628)

5'-GAGAGCUGCAUCAGUUCACUUUUGA$^{AA}$-3' (SEQ ID NO: 4402)
3'-CUCUCGACGUAGUCAAGUGAAAACU$_{GG}$-5' (SEQ ID NO: 2224)

AR-3756 Target: 5'-GAGAGCTGCATCAGTTCACTTTTGACC-3' (SEQ ID NO: 2629)

5'-AGAGCUGCAUCAGUUCACUUUUGAC$^{AC}$-3' (SEQ ID NO: 4403)
3'-UCUCGACGUAGUCAAGUGAAAACUG$_{A}$-5' (SEQ ID NO: 2225)

AR-3757 Target: 5'-AGAGCTGCATCAGTTCACTTTTGACCT-3' (SEQ ID NO: 2630)

5'-GAGCUGCAUCAGUUCACUUUUGACC$^{CA}$-3' (SEQ ID NO: 4404)
3'-CUCGACGUAGUCAAGUGAAAACUGG$_{AC}$-5' (SEQ ID NO: 2226)

AR-3758 Target: 5'-GAGCTGCATCAGTTCACTTTTGACCTG-3' (SEQ ID NO: 2631)

5'-AGCUGCAUCAGUUCACUUUUGACCU$^{AA}$-3' (SEQ ID NO: 4405)
3'-UCGACGUAGUCAAGUGAAAACUGGA$_{CG}$-5' (SEQ ID NO: 2227)

AR-3759 Target: 5'-AGCTGCATCAGTTCACTTTTGACCTGC-3' (SEQ ID NO: 2632)

5'-GCUGCAUCAGUUCACUUUUGACCUG$^{AC}$-3' (SEQ ID NO: 4406)
3'-CGACGUAGUCAAGUGAAAACUGGAC$_{GA}$-5' (SEQ ID NO: 2228)

AR-3760 Target: 5'-GCTGCATCAGTTCACTTTTGACCTGCT-3' (SEQ ID NO: 2633)

TABLE 5-continued

Selected Human Anti-AR 27mer "Blunt/Fray" DsiRNA Agents

5'-CUGCAUCAGUUCACUUUUGACCUGC$^{CC-3'}$ (SEQ ID NO: 4407)
3'-GACGUAGUCAAGUGAAAACUGGACG$_{A}{}_{U-5'}$ (SEQ ID NO: 2229)

AR-3761 Target: 5'-CTGCATCAGTTCACTTTTGACCTGCTA-3' (SEQ ID NO: 2634)

5'-UGCAUCAGUUCACUUUUGACCUGCU$^{CC-3'}$ (SEQ ID NO: 4408)
3'-ACGUAGUCAAGUGAAAACUGGACGA$_{U-5'}$ (SEQ ID NO: 2230)

AR-3762 Target: 5'-TGCATCAGTTCACTTTTGACCTGCTAA-3' (SEQ ID NO: 2635)

5'-GCAUCAGUUCACUUUUGACCUGCUA$^{CC-3'}$ (SEQ ID NO: 4409)
3'-CGUAGUCAAGUGAAAACUGGACGAU$_{A-5'}$ (SEQ ID NO: 2231)

AR-3763 Target: 5'-GCATCAGTTCACTTTTGACCTGCTAAT-3' (SEQ ID NO: 2636)

5'-CAUCAGUUCACUUUUGACCUGCUAA$^{CA-3'}$ (SEQ ID NO: 4410)
3'-GUAGUCAAGUGAAAACUGGACGAUU$_{A_{G-5'}}$ (SEQ ID NO: 2232)

AR-3764 Target: 5'-CATCAGTTCACTTTTGACCTGCTAATC-3' (SEQ ID NO: 2637)

5'-AUCAGUUCACUUUUGACCUGCUAAU$^{AC-3'}$ (SEQ ID NO: 4411)
3'-UAGUCAAGUGAAAACUGGACGAUUA$_{G_{U-5'}}$ (SEQ ID NO: 2233)

AR-3765 Target: 5'-ATCAGTTCACTTTTGACCTGCTAATCA-3' (SEQ ID NO: 2638)

5'-UCAGUUCACUUUUGACCUGCUAAUC$^{CC-3'}$ (SEQ ID NO: 4412)
3'-AGUCAAGUGAAAACUGGACGAUUAG$_{U-5'}$ (SEQ ID NO: 2234)

AR-3766 Target: 5'-TCAGTTCACTTTTGACCTGCTAATCAA-3' (SEQ ID NO: 2639)

5'-CAGUUCACUUUUGACCUGCUAAUCA$^{CA-3'}$ (SEQ ID NO: 4413)
3'-GUCAAGUGAAAACUGGACGAUUAGU$_{C-5'}$ (SEQ ID NO: 2235)

AR-3767 Target: 5'-CAGTTCACTTTTGACCTGCTAATCAAG-3' (SEQ ID NO: 2640)

5'-AGUUCACUUUUGACCUGCUAAUCAA$^{AC-3'}$ (SEQ ID NO: 4414)
3'-UCAAGUGAAAACUGGACGAUUAGUU$_{C_{A-5'}}$ (SEQ ID NO: 2236)

AR-3768 Target: 5'-AGTTCACTTTTGACCTGCTAATCAAGT-3' (SEQ ID NO: 2641)

5'-GUUCACUUUUGACCUGCUAAUCAAG$^{CA-3'}$ (SEQ ID NO: 4415)
3'-CAAGUGAAAACUGGACGAUUAGUUC$_{A_{G-5'}}$ (SEQ ID NO: 2237)

AR-3769 Target: 5'-GTTCACTTTTGACCTGCTAATCAAGTC-3' (SEQ ID NO: 2642)

5'-UUCACUUUUGACCUGCUAAUCAAGU$^{AC-3'}$ (SEQ ID NO: 4416)
3'-AAGUGAAAACUGGACGAUUAGUUCA$_{G_{U-5'}}$ (SEQ ID NO: 2238)

AR-3770 Target: 5'-TTCACTTTTGACCTGCTAATCAAGTCA-3' (SEQ ID NO: 2643)

5'-UCACUUUUGACCUGCUAAUCAAGUC$^{CA-3'}$ (SEQ ID NO: 4417)
3'-AGUGAAAACUGGACGAUUAGUUCAG$_{U_{G-5'}}$ (SEQ ID NO: 2239)

AR-3771 Target: 5'-TCACTTTTGACCTGCTAATCAAGTCAC-3' (SEQ ID NO: 2644)

5'-CACUUUUGACCUGCUAAUCAAGUCA$^{AC-3'}$ (SEQ ID NO: 4418)
3'-GUGAAAACUGGACGAUUAGUUCAGU$_{G_{U-5'}}$ (SEQ ID NO: 2240)

AR-3772 Target: 5'-CACTTTTGACCTGCTAATCAAGTCACA-3' (SEQ ID NO: 2645)

TABLE 5-continued

Selected Human Anti-AR 27mer "Blunt/Fray" DsiRNA Agents

5'-ACUUUUGACCUGCUAAUCAAGUCAC$^{CA-3'}$ (SEQ ID NO: 4419)
3'-UGAAAACUGGACGAUUAGUUCAGUG$_{UG-5'}$ (SEQ ID NO: 2241)

AR-3773 Target: 5'-ACTTTTGACCTGCTAATCAAGTCACAC-3' (SEQ ID NO: 2646)

5'-ACAUGGUGAGCGUGGACUUUCCGGA$^{CC-3'}$ (SEQ ID NO: 4420)
3'-UGUACCACUCGCACCUGAAAGGCCU$_{UU-5'}$ (SEQ ID NO: 2242)

AR-3798 Target: 5'-ACATGGTGAGCGTGGACTTTCCGGAAA-3' (SEQ ID NO: 2647)

5'-CAUGGUGAGCGUGGACUUUCCGGAA$^{CC-3'}$ (SEQ ID NO: 4421)
3'-GUACCACUCGCACCUGAAAGGCCUU$_{UA-5'}$ (SEQ ID NO: 2243)

AR-3799 Target: 5'-CATGGTGAGCGTGGACTTTCCGGAAAT-3' (SEQ ID NO: 2648)

5'-CGGAAAUGAUGGCAGAGAUCAUCUC$^{CA-3'}$ (SEQ ID NO: 4422)
3'-GCCUUUACUACCGUCUCUAGUAGAG$_{AC-5'}$ (SEQ ID NO: 2244)

AR-3819 Target: 5'-CGGAAATGATGGCAGAGATCATCTCTG-3' (SEQ ID NO: 2649)

5'-GGAAAUGAUGGCAGAGAUCAUCUCU$^{AC-3'}$ (SEQ ID NO: 4423)
3'-CCUUUACUACCGUCUCUAGUAGAGA$_{CA-5'}$ (SEQ ID NO: 2245)

AR-3820 Target: 5'-GGAAATGATGGCAGAGATCATCTCTGT-3' (SEQ ID NO: 2650)

5'-GAAAUGAUGGCAGAGAUCAUCUCUG$^{CA-3'}$ (SEQ ID NO: 4424)
3'-CUUUACUACCGUCUCUAGUAGAGAC$_{AC-5'}$ (SEQ ID NO: 2246)

AR-3821 Target: 5'-GAAATGATGGCAGAGATCATCTCTGTG-3' (SEQ ID NO: 2651)

5'-AAAUGAUGGCAGAGAUCAUCUCUGU$^{AA-3'}$ (SEQ ID NO: 4425)
3'-UUUACUACCGUCUCUAGUAGAGACA$_{CG-5'}$ (SEQ ID NO: 2247)

AR-3822 Target: 5'-AAATGATGGCAGAGATCATCTCTGTGC-3' (SEQ ID NO: 2652)

5'-AAUGAUGGCAGAGAUCAUCUCUGUG$^{AC-3'}$ (SEQ ID NO: 4426)
3'-UUACUACCGUCUCUAGUAGAGACAC$_{GU-5'}$ (SEQ ID NO: 2248)

AR-3823 Target: 5'-AATGATGGCAGAGATCATCTCTGTGCA-3' (SEQ ID NO: 2653)

5'-AUGAUGGCAGAGAUCAUCUCUGUGC$^{CC-3'}$ (SEQ ID NO: 4427)
3'-UACUACCGUCUCUAGUAGAGACACG$_{UU-5'}$ (SEQ ID NO: 2249)

AR-3824 Target: 5'-ATGATGGCAGAGATCATCTCTGTGCAA-3' (SEQ ID NO: 2654)

5'-UGAUGGCAGAGAUCAUCUCUGUGCA$^{CA-3'}$ (SEQ ID NO: 4428)
3'-ACUACCGUCUCUAGUAGAGACACGU$_{UC-5'}$ (SEQ ID NO: 2250)

AR-3825 Target: 5'-TGATGGCAGAGATCATCTCTGTGCAAG-3' (SEQ ID NO: 2655)

5'-GAUGGCAGAGAUCAUCUCUGUGCAA$^{AC-3'}$ (SEQ ID NO: 4429)
3'-CUACCGUCUCUAGUAGAGACACGUU$_{CA-5'}$ (SEQ ID NO: 2251)

AR-3826 Target: 5'-GATGGCAGAGATCATCTCTGTGCAAGT-3' (SEQ ID NO: 2656)

5'-AUGGCAGAGAUCAUCUCUGUGCAAG$^{CA-3'}$ (SEQ ID NO: 4430)
3'-UACCGUCUCUAGUAGAGACACGUUC$_{AC-5'}$ (SEQ ID NO: 2252)

AR-3827 Target: 5'-ATGGCAGAGATCATCTCTGTGCAAGTG-3' (SEQ ID NO: 2657)

TABLE 5-continued

Selected Human Anti-AR 27mer "Blunt/Fray" DsiRNA Agents

5'-UGGCAGAGAUCAUCUCUGUGCAAGU$^{A^{A-3'}}$ (SEQ ID NO: 4431)
3'-ACCGUCUCUAGUAGAGACACGUUCA$_{C_{G-5'}}$ (SEQ ID NO: 2253)

AR-3828 Target: 5'-TGGCAGAGATCATCTCTGTGCAAGTGC-3' (SEQ ID NO: 2658)

5'-GGCAGAGAUCAUCUCUGUGCAAGUG$^{A^{A-3'}}$ (SEQ ID NO: 4432)
3'-CCGUCUCUAGUAGAGACACGUUCAC$_{G_{G-5'}}$ (SEQ ID NO: 2254)

AR-3829 Target: 5'-GGCAGAGATCATCTCTGTGCAAGTGCC-3' (SEQ ID NO: 2659)

5'-GCAGAGAUCAUCUCUGUGCAAGUGC$^{A^{A-3'}}$ (SEQ ID NO: 4433)
3'-CGUCUCUAGUAGAGACACGUUCACG$_{G_{G-5'}}$ (SEQ ID NO: 2255)

AR-3830 Target: 5'-GCAGAGATCATCTCTGTGCAAGTGCCC-3' (SEQ ID NO: 2660)

5'-CAGAGAUCAUCUCUGUGCAAGUGCC$^{A^{C-3'}}$ (SEQ ID NO: 4434)
3'-GUCUCUAGUAGAGACACGUUCACGG$_{G_{U-5'}}$ (SEQ ID NO: 2256)

AR-3831 Target: 5'-CAGAGATCATCTCTGTGCAAGTGCCCA-3' (SEQ ID NO: 2661)

5'-AGAGAUCAUCUCUGUGCAAGUGCCC$^{C^{C-3'}}$ (SEQ ID NO: 4435)
3'-UCUCUAGUAGAGACACGUUCACGGG$_{U_{U-5'}}$ (SEQ ID NO: 2257)

AR-3832 Target: 5'-AGAGATCATCTCTGTGCAAGTGCCCAA-3' (SEQ ID NO: 2662)

5'-GAGAUCAUCUCUGUGCAAGUGCCCA$^{C^{A-3'}}$ (SEQ ID NO: 4436)
3'-CUCUAGUAGAGACACGUUCACGGGU$_{C_{C-5'}}$ (SEQ ID NO: 2258)

AR-3833 Target: 5'-GAGATCATCTCTGTGCAAGTGCCCAAG-3' (SEQ ID NO: 2663)

5'-AGAUCAUCUCUGUGCAAGUGCCCAA$^{A^{C-3'}}$ (SEQ ID NO: 4437)
3'-UCUAGUAGAGACACGUUCACGGGUU$_{C_{U-5'}}$ (SEQ ID NO: 2259)

AR-3834 Target: 5'-AGATCATCTCTGTGCAAGTGCCCAAGA-3' (SEQ ID NO: 2664)

5'-GAUCAUCUCUGUGCAAGUGCCCAAG$^{C^{C-3'}}$ (SEQ ID NO: 4438)
3'-CUAGUAGAGACACGUUCACGGGUUC$_{U_{A-5'}}$ (SEQ ID NO: 2260)

AR-3835 Target: 5'-GATCATCTCTGTGCAAGTGCCCAAGAT-3' (SEQ ID NO: 2665)

5'-AUCAUCUCUGUGCAAGUGCCCAAGA$^{C^{A-3'}}$ (SEQ ID NO: 4439)
3'-UAGUAGAGACACGUUCACGGGUUCU$_{A_{G-5'}}$ (SEQ ID NO: 2261)

AR-3836 Target: 5'-ATCATCTCTGTGCAAGTGCCCAAGATC-3'( SEQ ID NO: 2666)

5'-UCAUCUCUGUGCAAGUGCCCAAGAU$^{A^{A-3'}}$ (SEQ ID NO: 4440)
3'-AGUAGAGACACGUUCACGGGUUCUA$_{G_{G-5'}}$ (SEQ ID NO: 2262)

AR-3837 Target: 5'-TCATCTCTGTGCAAGTGCCCAAGATCC-3' (SEQ ID NO: 2667)

5'-CAUCUCUGUGCAAGUGCCCAAGAUC$^{A^{C-3'}}$ (SEQ ID NO: 4441)
3'-GUAGAGACACGUUCACGGGUUCUAG$_{G_{A-5'}}$ (SEQ ID NO: 2263)

AR-3838 Target: 5'-CATCTCTGTGCAAGTGCCCAAGATCCT-3' (SEQ ID NO: 2668)

5'-AUCUCUGUGCAAGUGCCCAAGAUCC$^{C^{C-3'}}$ (SEQ ID NO: 4442)
3'-UAGAGACACGUUCACGGGUUCUAGG$_{A_{A-5'}}$ (SEQ ID NO: 2264)

AR-3839 Target: 5'-ATCTCTGTGCAAGTGCCCAAGATCCTT-3' (SEQ ID NO: 2669)

TABLE 5-continued

Selected Human Anti-AR 27mer "Blunt/Fray" DsiRNA Agents

5'-UCUCUGUGCAAGUGCCCAAGAUCCU$^{C}$$^{C-3'}$ (SEQ ID NO: 4443)
3'-AGAGACACGUUCACGGGUUCUAGGA$_{A}$$_{A-5'}$ (SEQ ID NO: 2265)

AR-3840 Target: 5'-TCTCTGTGCAAGTGCCCAAGATCCTTT-3' (SEQ ID NO: 2670)

5'-CUCUGUGCAAGUGCCCAAGAUCCUU$^{C}$$^{A-3'}$ (SEQ ID NO: 4444)
3'-GAGACACGUUCACGGGUUCUAGGAA$_{A}$$_{G-5'}$ (SEQ ID NO: 2266)

AR-3841 Target: 5'-CTCTGTGCAAGTGCCCAAGATCCTTTC-3' (SEQ ID NO: 2671)

5'-UCUGUGCAAGUGCCCAAGAUCCUUU$^{A}$$^{C-3'}$ (SEQ ID NO: 4445)
3'-AGACACGUUCACGGGUUCUAGGAAA$_{G}$$_{A-5'}$ (SEQ ID NO: 2267)

AR-3842 Target: 5'-TCTGTGCAAGTGCCCAAGATCCTTTCT-3' (SEQ ID NO: 2672)

5'-CUGUGCAAGUGCCCAAGAUCCUUUC$^{C}$$^{A-3'}$ (SEQ ID NO: 4446)
3'-GACACGUUCACGGGUUCUAGGAAAG$_{A}$$_{C-5'}$ (SEQ ID NO: 2268)

AR-3843 Target: 5'-CTGTGCAAGTGCCCAAGATCCTTTCTG-3' (SEQ ID NO: 2673)

5'-UGUGCAAGUGCCCAAGAUCCUUUCU$^{A}$$^{A-3'}$ (SEQ ID NO: 4447)
3'-ACACGUUCACGGGUUCUAGGAAAGA$_{C}$$_{C-5'}$ (SEQ ID NO: 2269)

AR-3844 Target: 5'-TGTGCAAGTGCCCAAGATCCTTTCTGG-3' (SEQ ID NO: 2674)

5'-GUGCAAGUGCCCAAGAUCCUUUCUG$^{A}$$^{A-3'}$ (SEQ ID NO: 4448)
3'-CACGUUCACGGGUUCUAGGAAAGAC$_{C}$$_{C-5'}$ (SEQ ID NO: 2270)

AR-3845 Target: 5'-GTGCAAGTGCCCAAGATCCTTTCTGGG-3' (SEQ ID NO: 2675)

5'-UGCAAGUGCCCAAGAUCCUUUCUGG$^{A}$$^{C-3'}$ (SEQ ID NO: 4449)
3'-ACGUUCACGGGUUCUAGGAAAGACC$_{C}$$_{U-5'}$ (SEQ ID NO: 2271)

AR-3846 Target: 5'-TGCAAGTGCCCAAGATCCTTTCTGGGA-3' (SEQ ID NO: 2676)

5'-GCAAGUGCCCAAGAUCCUUUCUGGG$^{C}$$^{C-3'}$ (SEQ ID NO: 4450)
3'-CGUUCACGGGUUCUAGGAAAGACCC$_{U}$$_{U-5'}$ (SEQ ID NO: 2272)

AR-3847 Target: 5'-GCAAGTGCCCAAGATCCTTTCTGGGAA-3' (SEQ ID NO: 2677)

5'-CAAGUGCCCAAGAUCCUUUCUGGGA$^{C}$$^{C-3'}$ (SEQ ID NO: 4451)
3'-GUUCACGGGUUCUAGGAAAGACCCU$_{U}$$_{U-5'}$ (SEQ ID NO: 2273)

AR-3848 Target: 5'-CAAGTGCCCAAGATCCTTTCTGGGAAA-3' (SEQ ID NO: 2678)

5'-AAGUGCCCAAGAUCCUUUCUGGGAA$^{C}$$^{A-3'}$ (SEQ ID NO: 4452)
3'-UUCACGGGUUCUAGGAAAGACCCUU$_{U}$$_{C-5'}$ (SEQ ID NO: 2274)

AR-3849 Target: 5'-AAGTGCCCAAGATCCTTTCTGGGAAAG-3' (SEQ ID NO: 2679)

5'-AGUGCCCAAGAUCCUUUCUGGGAAA$^{A}$$^{C-3'}$ (SEQ ID NO: 4453)
3'-UCACGGGUUCUAGGAAAGACCCUUU$_{C}$$_{A-5'}$ (SEQ ID NO: 2275)

AR-3850 Target: 5'-AGTGCCCAAGATCCTTTCTGGGAAAGT-3' (SEQ ID NO: 2680)

5'-GUGCCCAAGAUCCUUUCUGGGAAAG$^{C}$$^{A-3'}$ (SEQ ID NO: 4454)
3'-CACGGGUUCUAGGAAAGACCCUUUC$_{A}$$_{G-5'}$ (SEQ ID NO: 2276)

AR-3851 Target: 5'-GTGCCCAAGATCCTTTCTGGGAAAGTC-3' (SEQ ID NO: 2681)

TABLE 5-continued

Selected Human Anti-AR 27mer "Blunt/Fray" DsiRNA Agents

5'-UGCCCAAGAUCCUUUCUGGGAAAGU$_A{}^{AC-3'}$ (SEQ ID NO: 4455)
3'-ACGGGUUCUAGGAAAGACCCUUUCAG$_{U-5'}$ (SEQ ID NO: 2277)

AR-3852 Target: 5'-TGCCCAAGATCCTTTCTGGGAAAGTCA-3' (SEQ ID NO: 2682)

5'-GCCCAAGAUCCUUUCUGGGAAAGUC$^{C-3'}$ (SEQ ID NO: 4456)
3'-CGGGUUCUAGGAAAGACCCUUUCAG$_{U-5'}$ (SEQ ID NO: 2278)

AR-3853 Target: 5'-GCCCAAGATCCTTTCTGGGAAAGTCAA-3' (SEQ ID NO: 2683)

5'-CCCAAGAUCCUUUCUGGGAAAGUCA$^{CA-3'}$ (SEQ ID NO: 4457)
3'-GGGUUCUAGGAAAGACCCUUUCAGU$_{C-5'}$ (SEQ ID NO: 2279)

AR-3854 Target: 5'-CCCAAGATCCTTTCTGGGAAAGTCAAG-3' (SEQ ID NO: 2684)

5'-CCAAGAUCCUUUCUGGGAAAGUCAA$^{AA-3'}$ (SEQ ID NO: 4458)
3'-GGUUCUAGGAAAGACCCUUUCAGUU$_{G-5'}$ (SEQ ID NO: 2280)

AR-3855 Target: 5'-CCAAGATCCTTTCTGGGAAAGTCAAGC-3' (SEQ ID NO: 2685)

5'-CAAGAUCCUUUCUGGGAAAGUCAAG$^{AA-3'}$ (SEQ ID NO: 4459)
3'-GUUCUAGGAAAGACCCUUUCAGUUC$_{G-5'}$ (SEQ ID NO: 2281)

AR-3856 Target: 5'-CAAGATCCTTTCTGGGAAAGTCAAGCC-3' (SEQ ID NO: 2686)

5'-AAGAUCCUUUCUGGGAAAGUCAAGC$^{AA-3'}$ (SEQ ID NO: 4460)
3'-UUCUAGGAAAGACCCUUUCAGUUCG$_{G-5'}$ (SEQ ID NO: 2282)

AR-3857 Target: 5'-AAGATCCTTTCTGGGAAAGTCAAGCCC-3' (SEQ ID NO: 2687)

5'-AGAUCCUUUCUGGGAAAGUCAAGCC$^{AC-3'}$ (SEQ ID NO: 4461)
3'-UCUAGGAAAGACCCUUUCAGUUCGG$_{U-5'}$ (SEQ ID NO: 2283)

AR-3858 Target: 5'-AGATCCTTTCTGGGAAAGTCAAGCCCA-3' (SEQ ID NO: 2688)

5'-GAUCCUUUCUGGGAAAGUCAAGCCC$^{CC-3'}$ (SEQ ID NO: 4462)
3'-CUAGGAAAGACCCUUUCAGUUCGGG$_{A-5'}$ (SEQ ID NO: 2284)

AR-3859 Target: 5'-GATCCTTTCTGGGAAAGTCAAGCCCAT-3' (SEQ ID NO: 2689)

5'-AUCCUUUCUGGGAAAGUCAAGCCCA$^{CA-3'}$ (SEQ ID NO: 4463)
3'-UAGGAAAGACCCUUUCAGUUCGGGU$_{G-5'}$ (SEQ ID NO: 2285)

AR-3860 Target: 5'-ATCCTTTCTGGGAAAGTCAAGCCCATC-3' (SEQ ID NO: 2690)

5'-UCCUUUCUGGGAAAGUCAAGCCCAU$^{AC-3'}$ (SEQ ID NO: 4464)
3'-AGGAAAGACCCUUUCAGUUCGGGUA$_{A-5'}$ (SEQ ID NO: 2286)

AR-3861 Target: 5'-TCCTTTCTGGGAAAGTCAAGCCCATCT-3' (SEQ ID NO: 2691)

5'-CCUUUCUGGGAAAGUCAAGCCCAUC$^{CC-3'}$ (SEQ ID NO: 4465)
3'-GGAAAGACCCUUUCAGUUCGGGUAG$_{U-5'}$ (SEQ ID NO: 2287)

AR-3862 Target: 5'-CCTTTCTGGGAAAGTCAAGCCCATCTA-3' (SEQ ID NO: 2692)

5'-CUUUCUGGGAAAGUCAAGCCCAUCU$^{CC-3'}$ (SEQ ID NO: 4466)
3'-GAAAGACCCUUUCAGUUCGGGUAGA$_{U-5'}$ (SEQ ID NO: 2288)

AR-3863 Target: 5'-CTTTCTGGGAAAGTCAAGCCCATCTAT-3' (SEQ ID NO: 2693)

TABLE 5-continued

Selected Human Anti-AR 27mer "Blunt/Fray" DsiRNA Agents

5'-UUUCUGGGAAAGUCAAGCCCAUCUA$^{\text{C}}$C-3' (SEQ ID NO: 4467)
3'-AAAGACCCUUUCAGUUCGGGUAGAU$_{\text{A}}$A-5' (SEQ ID NO: 2289)

AR-3864 Target: 5'-TTTCTGGGAAAGTCAAGCCCATCTATT-3' (SEQ ID NO: 2694)

5'-UUCUGGGAAAGUCAAGCCCAUCUAU$^{\text{C}}$C-3' (SEQ ID NO: 4468)
3'-AAGACCCUUUCAGUUCGGGUAGAUA$_{\text{A}}$A-5' (SEQ ID NO: 2290)

AR-3865 Target: 5'-TTCTGGGAAAGTCAAGCCCATCTATTT-3' (SEQ ID NO: 2695)

5'-UCUGGGAAAGUCAAGCCCAUCUAUU$^{\text{C}}$A-3' (SEQ ID NO: 4469)
3'-AGACCCUUUCAGUUCGGGUAGAUAA$_{\text{A}}$G-5' (SEQ ID NO: 2291)

AR-3866 Target: 5'-TCTGGGAAAGTCAAGCCCATCTATTTC-3' (SEQ ID NO: 2696)

5'-CUGGGAAAGUCAAGCCCAUCUAUUU$^{\text{A}}$A-3' (SEQ ID NO: 4470)
3'-GACCCUUUCAGUUCGGGUAGAUAAA$_{\text{G}}$G-5' (SEQ ID NO: 2292)

AR-3867 Target: 5'-CTGGGAAAGTCAAGCCCATCTATTTCC-3' (SEQ ID NO: 2697)

5'-UGGGAAAGUCAAGCCCAUCUAUUUC$^{\text{A}}$C-3' (SEQ ID NO: 4471)
3'-ACCCUUUCAGUUCGGGUAGAUAAAG$_{\text{U}}$-5' (SEQ ID NO: 2293)

AR-3868 Target: 5'-TGGGAAAGTCAAGCCCATCTATTTCCA-3' (SEQ ID NO: 2698)

5'-GGGAAAGUCAAGCCCAUCUAUUUCC$^{\text{C}}$A-3' (SEQ ID NO: 4472)
3'-CCCUUUCAGUUCGGGUAGAUAAAGG$_{\text{U}}$G-5' (SEQ ID NO: 2294)

AR-3869 Target: 5'-GGGAAAGTCAAGCCCATCTATTTCCAC-3' (SEQ ID NO: 2699)

5'-GGAAAGUCAAGCCCAUCUAUUUCCA$^{\text{A}}$C-3' (SEQ ID NO: 4473)
3'-CCUUUCAGUUCGGGUAGAUAAAGGU$_{\text{U}}$-5' (SEQ ID NO: 2295)

AR-3870 Target: 5'-GGAAAGTCAAGCCCATCTATTTCCACA-3' (SEQ ID NO: 2700)

5'-GAAAGUCAAGCCCAUCUAUUUCCAC$^{\text{C}}$A-3' (SEQ ID NO: 4474)
3'-CUUUCAGUUCGGGUAGAUAAAGGUG$_{\text{U}}$G-5' (SEQ ID NO: 2296)

AR-3871 Target: 5'-GAAAGTCAAGCCCATCTATTTCCACAC-3' (SEQ ID NO: 2701)

5'-UUCAGAUGUCUUCUGCCUGUUAUAA$^{\text{A}}$C-3' (SEQ ID NO: 4475)
3'-AAGUCUACAGAAGACGGACAAUAUU$_{\text{G}}$A-5' (SEQ ID NO: 2297)

AR-3947 Target: 5'-TTCAGATGTCTTCTGCCTGTTATAACT-3' (SEQ ID NO: 2702)

5'-UCAGAUGUCUUCUGCCUGUUAUAAC$^{\text{C}}$A-3' (SEQ ID NO: 4476)
3'-AGUCUACAGAAGACGGACAAUAUUG$_{\text{A}}$G-5' (SEQ ID NO: 2298)

AR-3948 Target: 5'-TCAGATGTCTTCTGCCTGTTATAACTC-3' (SEQ ID NO: 2703)

5'-CAGAUGUCUUCUGCCUGUUAUAACU$^{\text{A}}$C-3' (SEQ ID NO: 4477)
3'-GUCUACAGAAGACGGACAAUAUUGA$_{\text{A}}$G-5' (SEQ ID NO: 2299)

AR-3949 Target: 5'-CAGATGTCTTCTGCCTGTTATAACTCT-3' (SEQ ID NO: 2704)

5'-AGAUGUCUUCUGCCUGUUAUAACUC$^{\text{A}}$C-3' (SEQ ID NO: 4478)
3'-UCUACAGAAGACGGACAAUAUUGAG$_{\text{C}}$A-5' (SEQ ID NO: 2300)

AR-3950 Target: 5'-AGATGTCTTCTGCCTGTTATAACTCTG-3' (SEQ ID NO: 2705)

TABLE 5-continued

Selected Human Anti-AR 27mer "Blunt/Fray" DsiRNA Agents

5'-GGGGAAUUUCCUCUAUUGAUGUACA$^{AC-3'}$ (SEQ ID NO: 4479)
3'-CCCCUUAAAGGAGAUAACUACAUGU$_{A-5'}^{C}$ (SEQ ID NO: 2301)

AR-3999 Target: 5'-GGGGAATTTCCTCTATTGATGTACAGT-3' (SEQ ID NO: 2706)

5'-UUGCUGGGCUUUUUUUUCUCUUUC$^{CA-3'}$ (SEQ ID NO: 4480)
3'-AACGACCCGAAAAAAAAAGAGAAAG$_{G-5'}^{A}$ (SEQ ID NO: 2302)

AR-4054 Target: 5'-TTGCTGGGCTTTTTTTTCTCTTTCTC-3' (SEQ ID NO: 2707)

5'-UGCUGGGCUUUUUUUUCUCUUUCU$^{AC-3'}$ (SEQ ID NO: 4481)
3'-ACGACCCGAAAAAAAAAGAGAAAGA$_{G-5'}^{A}$ (SEQ ID NO: 2303)

AR-4055 Target: 5'-TGCTGGGCTTTTTTTTCTCTTTCT-3' (SEQ ID NO: 2708)

5'-GCUUUUUUUUCUCUUUCUCUCCUU$^{CA-3'}$ (SEQ ID NO: 4482)
3'-CGAAAAAAAAGAGAAAGAGAGGAA$_{G-5'}^{A}$ (SEQ ID NO: 2304)

AR-4061 Target: 5'-GCTTTTTTTTCTCTTTCTCTCCTTTC-3' (SEQ ID NO: 2709)

5'-UUUUUUCUCUUUCUCUCCUUUCUUU$^{CC-3'}$ (SEQ ID NO: 4483)
3'-AAAAAAGAGAAAGAGAGGAAAGAAA$_{A-5'}^{A}$ (SEQ ID NO: 2305)

AR-4066 Target: 5'-TTTTTTCTCTTTCTCTCCTTTCTTTTT-3' (SEQ ID NO: 2710)

5'-UCUUUUUCUUCUUCCCUCCCUAUCU$^{CC-3'}$ (SEQ ID NO: 4484)
3'-AGAAAAAGAAGAAGGGAGGGAUAGA$_{U-5'}^{U}$ (SEQ ID NO: 2306)

AR-4086 Target: 5'-TCTTTTTCTTCTTCCCTCCCTATCTAA-3' (SEQ ID NO: 2711)

5'-UGUUGUAUGCCUUUAAAUCUGUGAU$^{AC-3'}$ (SEQ ID NO: 4485)
3'-ACAACAUACGGAAAUUUAGACACUA$_{U-5'}^{C}$ (SEQ ID NO: 2307)

AR-4174 Target: 5'-TGTTGTATGCCTTTAAATCTGTGATGA-3' (SEQ ID NO: 2712)

5'-UGUGCUUGUUUACAGCACUACUCUG$^{CA-3'}$ (SEQ ID NO: 4486)
3'-ACACGAACAAAUGUCGUGAUGAGAC$_{C-5'}^{A}$ (SEQ ID NO: 2308)

AR-4225 Target: 5'-TGTGCTTGTTTACAGCACTACTCTGTG-3' (SEQ ID NO: 2713)

5'-UUAGAGAGCUAAGAUUAUCUGGGGA$^{CC-3'}$ (SEQ ID NO: 4487)
3'-AAUCUCUCGAUUCUAAUAGACCCCU$_{U-5'}^{U}$ (SEQ ID NO: 2309)

AR-4293 Target: 5'-TTAGAGAGCTAAGATTATCTGGGGAAA-3' (SEQ ID NO: 2714)

5'-GGGGAAAUCAAAACAAAAACAAGCA$^{CC-3'}$ (SEQ ID NO: 4488)
3'-CCCCUUUAGUUUUGUUUUUGUUCGU$_{U-5'}^{U}$ (SEQ ID NO: 2310)

AR-4313 Target: 5'-GGGGAAATCAAAACAAAAACAAGCAAA-3' (SEQ ID NO: 2715)

TABLE 6

Selected Mouse Anti-AR 27mer "Blunt/Fray" DsiRNA Agents

5'-GGCAGCAGCACACUGAGGAUGGUUC$^{cA-3'}$ (SEQ ID NO: 4459)
3'-CCGUCGUCGUGUGACUCCUACCAAG$_{CA-5'}$ (SEQ ID NO: 3574)

AR-m258 Target: 5'-GGCAGCAGCACACTGAGGATGGTTCTC-3' (SEQ ID NO: 3622)

5'-CUCCGAGGGCCACCCUGAGAGCAGC$^{cA-3'}$ (SEQ ID NO: 4460)
3'-GAGGCUCCCGGUGGGACUCUCGUCG$_{AC-5'}$ (SEQ ID NO: 3575)

AR-m361 Target: 5'-CTCCGAGGGCCACCCTGAGAGCAGCTG-3' (SEQ ID NO: 3623)

5'-GGGCCACCCUGAGAGCAGCUGCCUC$^{AA-3'}$ (SEQ ID NO: 4461)
3'-CCCGGUGGGACUCUCGUCGACGGAG$_{GG-5'}$ (SEQ ID NO: 3576)

AR-m367 Target: 5'-GGGCCACCCTGAGAGCAGCTGCCTCCC-3' (SEQ ID NO: 3624)

5'-GGCUGCCGCAGCAGCCACCAGCUCC$^{cA-3'}$ (SEQ ID NO: 4462)
3'-CCGACGGCGUCGUCGGUGGUCGAGG$_{AG-5'}$ (SEQ ID NO: 3577)

AR-m426 Target: 5'-GGCTGCCGCAGCAGCCACCAGCTCCTC-3' (SEQ ID NO: 3625)

5'-CACUUUCCCAGGCUUAAGCAGCUGC$^{cA-3'}$ (SEQ ID NO: 4463)
3'-GUGAAAGGGUCCGAAUUCGUCGACU$_{AG-5'}$ (SEQ ID NO: 3578)

AR-m502 Target: 5'-CACTTTCCCAGGCTTAAGCAGCTGCTC-3' (SEQ ID NO: 3626)

5'-AUGCAACUUCUUCAGCAGCAGCAAC$^{cC-3'}$ (SEQ ID NO: 4464)
3'-UACGUUGAAGAAGUCGUCGUCGUUG$_{UU-5'}$ (SEQ ID NO: 3579)

AR-m566 Target: 5'-ATGCAACTTCTTCAGCAGCAGCAACAA-3' (SEQ ID NO: 3627)

5'-GUGCGUCCCACUCCUUGUGCGCCGC$^{cA-3'}$ (SEQ ID NO: 4465)
3'-CACGCAGGGUGAGGAACACGCGGCG$_{AC-5'}$ (SEQ ID NO: 3580)

AR-m872 Target: 5'-GTGCGTCCCACTCCTTGTGCGCCGCTG-3' (SEQ ID NO: 3628)

5'-CUGGCAGCAGUGAAGCAGGUAGCUC$^{cA-3'}$ (SEQ ID NO: 4466)
3'-GACCGUCGUCACUUCGUCCAUCGAG$_{AC-5'}$ (SEQ ID NO: 3581)

AR-m1020 Target: 5'-CTGGCAGCAGTGAAGCAGGTAGCTCTG-3' (SEQ ID NO: 3629)

5'-UUUCCGCUGGCUCUGUCCGGGCCGC$^{AA-3'}$ (SEQ ID NO: 4467)
3'-AAAGGCGACCGAGACAGGCCCGGCG$_{GC-5'}$ (SEQ ID NO: 3582)

AR-m1136 Target: 5'-TTTCCGCTGGCTCTGTCCGGGCCGCCG-3' (SEQ ID NO: 3630)

5'-GCAGCGCCUGGGCUGCGGCGGCAGC$^{AA-3'}$ (SEQ ID NO: 4468)
3'-CGUCGCGGACCCGACGCCGCCGUCG$_{CG-5'}$ (SEQ ID NO: 3583)

AR-m1224 Target: 5'-GCAGCGCCTGGGCTGCGGCGGCAGCGC-3' (SEQ ID NO: 3631)

5'-GCCUGGGCUGCGGCGGCAGCGCAAU$^{AA-3'}$ (SEQ ID NO: 4469)
3'-CGGACCCGACGCCGCCGUCGCGUUA$_{CG-5'}$ (SEQ ID NO: 3584)

AR-m1229 Target: 5'-GCCTGGGCTGCGGCGGCAGCGCAATGC-3' (SEQ ID NO: 3632)

5'-CUGCGGCGGCAGCGCAAUGCCGCUA$^{cA-3'}$ (SEQ ID NO: 4470)
3'-GACGCCGCCGUCGCGUUACGGCGAU$_{AC-5'}$ (SEQ ID NO: 3585)

AR-m1236 Target: 5'-CTGCGGCGGCAGCGCAATGCCGCTATG-3' (SEQ ID NO: 3633)

5'-UGUAGCCGGGCCCAGCACUGGAUCG$^{AA-3'}$ (SEQ ID NO: 4471)
3'-ACAUCGGCCCGGGUCGUGACCUAGC$_{GG-5'}$ (SEQ ID NO: 3586)

AR-m1291 Target: 5'-TGTAGCCGGGCCCAGCACTGGATCGCC-3' (SEQ ID NO: 3634)

TABLE 6-continued

Selected Mouse Anti-AR 27mer "Blunt/Fray" DsiRNA Agents

5'-CUUCCUGGCAUACUCUCUUCACAGC$^{cA-3'}$ (SEQ ID NO: 4472)
3'-GAAGGACCGUAUGAGAGAAGUGUCG$_{AC-5'}$ (SEQ ID NO: 3587)

AR-m1335 Target: 5'-CTTCCTGGCATACTCTCTTCACAGCTG-3' (SEQ ID NO: 3635)

5'-AGCAGCCCAAGCGAUGCCGGGCCUG$^{cC-3'}$ (SEQ ID NO: 4473)
3'-UCGUCGGGUUCGCUACGGCCCGGAC$_{AU-5'}$ (SEQ ID NO: 3588)

AR-m1403 Target: 5'-AGCAGCCCAAGCGATGCCGGGCCTGTA-3' (SEQ ID NO: 3636)

5'-GCUUCUGGCUGUCACUACGGAGCUC$^{cA-3'}$ (SEQ ID NO: 4474)
3'-CGAAGACCGACAGUGAUGCCUCGAG$_{AG-5'}$ (SEQ ID NO: 3589)

AR-m1694 Target: 5'-GCTTCTGGCTGTCACTACGGAGCTCTC-3' (SEQ ID NO: 3637)

5'-CGGAGCUCUCACUUGUGGCAGCUGC$^{cC-3'}$ (SEQ ID NO: 4475)
3'-GCCUCGAGAGUGAACACCGUCGACG$_{UU-5'}$ (SEQ ID NO: 3590)

AR-m1711 Target: 5'-CGGAGCTCTCACTTGTGGCAGCTGCAA-3' (SEQ ID NO: 3638)

5'-CACUUGUGGCAGCUGCAAGGUCUUC$^{cC-3'}$ (SEQ ID NO: 4476)
3'-GUGAACACCGUCGACGUUCCAGAAG$_{AA-5'}$ (SEQ ID NO: 3591)

AR-m1720 Target: 5'-CACTTGTGGCAGCTGCAAGGTCTTCTT-3' (SEQ ID NO: 3639)

5'-GUGGCAGCUGCAAGGUCUUCUUCAA$^{cC-3'}$ (SEQ ID NO: 4477)
3'-CACCGUCGACGUUCCAGAAGAAGUU$_{UU-5'}$ (SEQ ID NO: 3592)

AR-m1725 Target: 5'-GTGGCAGCTGCAAGGTCTTCTTCAAAA-3' (SEQ ID NO: 3640)

5'-GGGAUGACUCUGGGAGCUCGUAAGC$^{cA-3'}$ (SEQ ID NO: 4478)
3'-CCCUACUGAGACCCUCGAGCAUUCG$_{AC-5'}$ (SEQ ID NO: 3593)

AR-m1865 Target: 5'-GGGATGACTCTGGGAGCTCGTAAGCTG-3' (SEQ ID NO: 3641)

5'-CUGGGAGCUCGUAAGCUGAAGAAAC$^{cC-3'}$ (SEQ ID NO: 4479)
3'-GACCCUCGAGCAUUCGACUUCUUUG$_{AA-5'}$ (SEQ ID NO: 3594)

AR-m1874 Target: 5'-CTGGGAGCTCGTAAGCTGAAGAAACTT-3' (SEQ ID NO: 3642)

5'-CAGAUUCCUUUGCUGCCUUGUUAUC$^{cC-3'}$ (SEQ ID NO: 4480)
3'-GUCUAAGGAAACGACGGAACAAUAG$_{AU-5'}$ (SEQ ID NO: 3595)

AR-m2079 Target: 5'-CAGATTCCTTTGCTGCCTTGTTATCTA-3' (SEQ ID NO: 3643)

5'-CUUUGCUGCCUUGUUAUCUAGCCUC$^{cC-3'}$ (SEQ ID NO: 4481)
3'-GAAACGACGGAACAAUAGAUCGGAG$_{UU-5'}$ (SEQ ID NO: 3596)

AR-m2086 Target: 5'-CTTTGCTGCCTTGTTATCTAGCCTCAA-3' (SEQ ID NO: 3644)

5'-UUGCCUGGCUUCCGCAACUUGCAUG$^{cA-3'}$ (SEQ ID NO: 4482)
3'-AACGGACCGAAGGCGUUGAACGUAC$_{AC-5'}$ (SEQ ID NO: 3597)

AR-m2162 Target: 5'-TTGCCTGGCTTCCGCAACTTGCATGTG-3' (SEQ ID NO: 3645)

5'-UGGAUGGGACUGAUGGUAUUUGCCA$^{cA-3'}$ (SEQ ID NO: 4483)
3'-ACCUACCCUGACUACCAUAAACGGU$_{AC-5'}$ (SEQ ID NO: 3598)

AR-m2219 Target: 5'-TGGATGGGACTGATGGTATTTGCCATG-3' (SEQ ID NO: 3646)

5'-CAGGAUGCUCUACUUUGCACCUGAC$^{cC-3'}$ (SEQ ID NO: 4484)
3'-GUCCUACGAGAUGAAACGUGGACUG$_{AA-5'}$ (SEQ ID NO: 3599)

AR-m2275 Target: 5'-CAGGATGCTCTACTTTGCACCTGACTT-3' (SEQ ID NO: 3647)

5'-UGCUCUACUUUGCACCUGACUUGGU$^{cC-3'}$ (SEQ ID NO: 4485)
3'-ACGAGAUGAAACGUGGACUGAACCA$_{AA-5'}$ (SEQ ID NO: 3600)

AR-m2280 Target: 5'-TGCTCTACTTTGCACCTGACTTGGTTT-3' (SEQ ID NO: 3648)

TABLE 6-continued

Selected Mouse Anti-AR 27mer "Blunt/Fray" DsiRNA Agents

5'-CUUUGCACCUGACUUGGUUUUCAAU$^{A}$$^{C-3'}$ (SEQ ID NO: 4486)
3'-GAAACGUGGACUGAACCAAAAGUUA$_{C}$$_{U-5'}$ (SEQ ID NO: 3601)

AR-m2287 Target: 5'-CTTTGCACCTGACTTGGTTTTCAATGA-3' (SEQ ID NO: 3649)

5'-GACUUGGUUUUCAAUGAGUACCGCA$^{C}$$^{A-3'}$ (SEQ ID NO: 4487)
3'-CUGAACCAAAAGUUACUCAUGGCGU$_{A}$$_{C-5'}$ (SEQ ID NO: 3602)

AR-m2297 Target: 5'-GACTTGGTTTTCAATGAGTACCGCATG-3' (SEQ ID NO: 3650)

5'-GAGUACCGCAUGCACAAGUCUCGGA$^{C}$$^{A-3'}$ (SEQ ID NO: 4488)
3'-CUCAUGGCGUACGUGUUCAGAGCCU$_{A}$$_{C-5'}$ (SEQ ID NO: 3603)

AR-m2312 Target: 5'-GAGTACCGCATGCACAAGTCTCGGATG-3' (SEQ ID NO: 3651)

5'-CUGUGCAUGAAAGCACUGCUGCUCU$^{C}$$^{A-3'}$ (SEQ ID NO: 4489)
3'-GACACGUACUUUCGUGACGACGAGA$_{A}$$_{G-5'}$ (SEQ ID NO: 3604)

AR-m2411 Target: 5'-CTGTGCATGAAAGCACTGCTGCTCTTC-3' (SEQ ID NO: 3652)

5'-CAUGAAAGCACUGCUGCUCUUCAGC$^{C}$$^{C-3'}$ (SEQ ID NO: 4490)
3'-GUACUUUCGUGACGACGAGAAGUCG$_{U}$$_{A-5'}$ (SEQ ID NO: 3605)

AR-m2416 Target: 5'-CATGAAAGCACTGCTGCTCTTCAGCAT-3' (SEQ ID NO: 3653)

5'-AGCACUGCUGCUCUUCAGCAUUAUU$^{A}$$^{A-3'}$ (SEQ ID NO: 4491)
3'-UCGUGACGACGAGAAGUCGUAAUAA$_{G-5'}$ (SEQ ID NO: 3606)

AR-m2422 Target: 5'-AGCACTGCTGCTCTTCAGCATTATTCC-3' (SEQ ID NO: 3654)

5'-UGCUGCUCUUCAGCAUUAUUCCAGU$^{A}$$^{A-3'}$ (SEQ ID NO: 4492)
3'-ACGACGAGAAGUCGUAAUAAGGUCA$_{C}$$_{C-5'}$ (SEQ ID NO: 3607)

AR-m2427 Target: 5'-TGCTGCTCTTCAGCATTATTCCAGTGG-3' (SEQ ID NO: 3655)

5'-AGCUCACCAAGCUCCUGGAUUCUGU$^{A}$$^{A-3'}$ (SEQ ID NO: 4493)
3'-UCGAGUGGUUCGAGGACCUAAGACA$_{C}$$_{G-5'}$ (SEQ ID NO: 3608)

AR-m2571 Target: 5'-AGCTCACCAAGCTCCTGGATTCTGTGC-3' (SEQ ID NO: 3656)

5'-AGCUCCUGGAUUCUGUGCAGCCUAU$^{C}$$^{A-3'}$ (SEQ ID NO: 4494)
3'-UCGAGGACCUAAGACACGUCGGAUA$_{A}$$_{C-5'}$ (SEQ ID NO: 3609)

AR-m2580 Target: 5'-AGCTCCTGGATTCTGTGCAGCCTATTG-3' (SEQ ID NO: 3657)

5'-CUGGAUUCUGUGCAGCCUAUUGCAA$^{A}$$^{C-3'}$ (SEQ ID NO: 4495)
3'-GACCUAAGACACGUCGGAUAACGUU$_{C}$$_{U-5'}$ (SEQ ID NO: 3610)

AR-m2585 Target: 5'-CTGGATTCTGTGCAGCCTATTGCAAGA-3' (SEQ ID NO: 3658)

5'-UCUGUGCAGCCUAUUGCAAGAGAGC$^{C}$$^{A-3'}$ (SEQ ID NO: 4496)
3'-AGACACGUCGGAUAACGUUCUCUCG$_{A}$$_{C-5'}$ (SEQ ID NO: 3611)

AR-m2591 Target: 5'-TCTGTGCAGCCTATTGCAAGAGAGCTG-3' (SEQ ID NO: 3659)

5'-CAGCCUAUUGCAAGAGAGCUGCAUC$^{C}$$^{A-3'}$ (SEQ ID NO: 4497)
3'-GUCGGAUAACGUUCUCUCGACGUAG$_{U}$$_{C-5'}$ (SEQ ID NO: 3612)

AR-m2597 Target: 5'-CAGCCTATTGCAAGAGAGCTGCATCAG-3' (SEQ ID NO: 3660)

5'-GCGUGGACUUUCCUGAAAUGAUGGC$^{C}$$^{A-3'}$ (SEQ ID NO: 4498)
3'-CGCACCUGAAAGGACUUUACUACCG$_{U}$$_{C-5'}$ (SEQ ID NO: 3613)

AR-m2661 Target: 5'-GCGTGGACTTTCCTGAAATGATGGCAG-3' (SEQ ID NO: 3661)

5'-UCUUCUGCCUGUUAUAUAACUCUGC$^{C}$$^{A-3'}$ (SEQ ID NO: 4499)
3'-AGAAGACGGACAAUAUAUUGAGACG$_{U}$$_{G-5'}$ (SEQ ID NO: 3614)

AR-m2809 Target: 5'-TCTTCTGCCTGTTATATAACTCTGCAC-3' (SEQ ID NO: 3662)

TABLE 6-continued

Selected Mouse Anti-AR 27mer "Blunt/Fray" DsiRNA Agents

5'-UGCACUACUUCUCUGCAGUGCCUUG$^{AA}$-3'  (SEQ ID NO: 4500)
3'-ACGUGAUGAAGAGACGUCACGGAAC$_{CC}$-5'  (SEQ ID NO: 3615)

AR-m2831 Target: 5'-TGCACTACTTCTCTGCAGTGCCTTGGG-3'  (SEQ ID NO: 3663)

5'-UCCUGGGCUUCUCCUUCUUUUUUUU$^{CA}$-3'  (SEQ ID NO: 4501)
3'-AGGACCCGAAGAGGAAGAAAAAAAAA$_{AG}$-5'  (SEQ ID NO: 3616)

AR-m2912 Target: 5'-TCCTGGGCTTCTCCTTCTTTTTTTTC-3'  (SEQ ID NO: 3664)

5'-GCUUCUCCUUCUUUUUUUUUCUUCU$^{CA}$-3'  (SEQ ID NO: 4502)
3'-CGAAGAGGAAGAAAAAAAAAGAAGA$_{AG}$-5'  (SEQ ID NO: 3617)

AR-m2918 Target: 5'-GCTTCTCCTTCTTTTTTTTCTTCTTC-3'  (SEQ ID NO: 3665)

5'-UUCUUUUUUUUCUUCUUCCCUCCC$^{CA}$-3'  (SEQ ID NO: 4503)
3'-AAGAAAAAAAAGAAGAAGGGAGGG$_{AG}$-5'  (SEQ ID NO: 3618)

AR-m2926 Target: 5'-TTCTTTTTTTTCTTCTTCCCTCCCTC-3'  (SEQ ID NO: 3666)

5'-CUGCUGCGUAUUGUGGCUCCUGCCU$^{CC}$-3'  (SEQ ID NO: 4504)
3'-GACGACGCAUAACACCGAGGACGGA$_{AA}$-5'  (SEQ ID NO: 3619)

AR-m2981 Target: 5'-CTGCTGCGTATTGTGGCTCCTGCCTTT-3'  (SEQ ID NO: 3667)

5'-UGUGGCUCCUGCCUUUGUUUUGAUU$^{CA}$-3'  (SEQ ID NO: 4505)
3'-ACACCGAGGACGGAAACAAAACUAA$_{AG}$-5'  (SEQ ID NO: 3620)

AR-m2992 Target: 5'-TGTGGCTCCTGCCTTTGTTTTGATTTC-3'  (SEQ ID NO: 3668)

5'-CUCCUGCCUUUGUUUUGAUUUCUGU$^{CA}$-3'  (SEQ ID NO: 4506)
3'-GAGGACGGAAACAAAACUAAAGACA$_{AC}$-5'  (SEQ ID NO: 3621)

AR-m2997 Target: 5'-CTCCTGCCTTTGTTTTGATTTCTGTTG-3'  (SEQ ID NO: 3669)

TABLE 7

Selected Human Anti-AR 27mer "Blunt/Blunt" DsiRNA Agents

|  | | |
|---|---|---|
| | 5'-UGAAGUUUUUAAAAGCUGCUAAAGACU-3' | (SEQ ID NO: 4507) |
| | 3'-ACUUCAAAAAUUUUCGACGAUUUCUGA-5' | (SEQ ID NO: 154) |
| AR-252 Target: | 5'-TGAAGTTTTTAAAAGCTGCTAAAGACT-3' | (SEQ ID NO: 307) |
| | 5'-GAAGUUUUUAAAAGCUGCUAAAGACUC-3' | (SEQ ID NO: 4508) |
| | 3'-CUUCAAAAAUUUUCGACGAUUUCUGAG-5' | (SEQ ID NO: 155) |
| AR-253 Target: | 5'-GAAGTTTTTAAAAGCTGCTAAAGACTC-3' | (SEQ ID NO: 308) |
| | 5'-AAGUUUUUAAAAGCUGCUAAAGACUCG-3' | (SEQ ID NO: 4509) |
| | 3'-UUCAAAAAUUUUCGACGAUUUCUGAGC-5' | (SEQ ID NO: 156) |
| AR-254 Target: | 5'-AAGTTTTTAAAAGCTGCTAAAGACTCG-3' | (SEQ ID NO: 309) |
| | 5'-UGCGGAGCCAGAGAUCAAAAGAUGAAA-3' | (SEQ ID NO: 4510) |
| | 3'-ACGCCUCGGUCUCUAGUUUUCUACUUU-5' | (SEQ ID NO: 157) |
| AR-682 Target: | 5'-TGCGGAGCCAGAGATCAAAAGATGAAA-3' | (SEQ ID NO: 310) |
| | 5'-GCCAGAGAUCAAAAGAUGAAAAGGCAG-3' | (SEQ ID NO: 4511) |
| | 3'-CGGUCUCUAGUUUUCUACUUUUCCGUC-5' | (SEQ ID NO: 158) |
| AR-688 Target: | 5'-GCCAGAGATCAAAAGATGAAAAGGCAG-3' | (SEQ ID NO: 311) |
| | 5'-CCAGAGAUCAAAAGAUGAAAAGGCAGU-3' | (SEQ ID NO: 4512) |
| | 3'-GGUCUCUAGUUUUCUACUUUUCCGUCA-5' | (SEQ ID NO: 159) |
| AR-689 Target: | 5'-CCAGAGATCAAAAGATGAAAAGGCAGT-3' | (SEQ ID NO: 312) |
| | 5'-CAAAAGAUGAAAAGGCAGUCAGGUCUU-3' | (SEQ ID NO: 4513) |
| | 3'-GUUUUCUACUUUUCCGUCAGUCCAGAA-5' | (SEQ ID NO: 160) |

TABLE 7-continued

Selected Human Anti-AR 27mer "Blunt/Blunt" DsiRNA Agents

| | | | |
|---|---|---|---|
| AR-697 Target: | 5'-CAAAAGATGAAAAGGCAGTCAGGTCTT-3' | (SEQ ID NO: 313) | |
| | 5'-AAAAGAUGAAAAGGCAGUCAGGUCUUC-3' | (SEQ ID NO: 4514) | |
| | 3'-UUUUCUACUUUUCCGUCAGUCCAGAAG-5' | (SEQ ID NO: 161) | |
| AR-698 Target: | 5'-AAAAGATGAAAAGGCAGTCAGGTCTTC-3' | (SEQ ID NO: 314) | |
| | 5'-GUCAGGUCUUCAGUAGCCAAAAAACAA-3' | (SEQ ID NO: 4515) | |
| | 3'-CAGUCCAGAAGUCAUCGGUUUUUUGUU-5' | (SEQ ID NO: 162) | |
| AR-714 Target: | 5'-GTCAGGTCTTCAGTAGCCAAAAAACAA-3' | (SEQ ID NO: 315) | |
| | 5'-UCAGGUCUUCAGUAGCCAAAAAACAAA-3' | (SEQ ID NO: 4516) | |
| | 3'-AGUCCAGAAGUCAUCGGUUUUUUGUUU-5' | (SEQ ID NO: 163) | |
| AR-715 Target: | 5'-TCAGGTCTTCAGTAGCCAAAAAACAAA-3' | (SEQ ID NO: 316) | |
| | 5'-CAGUAGCCAAAAAACAAACAAACAAA-3' | (SEQ ID NO: 4517) | |
| | 3'-GUCAUCGGUUUUUUGUUUGUUUGUUU-5' | (SEQ ID NO: 164) | |
| AR-724 Target: | 5'-CAGTAGCCAAAAAACAAACAAACAAA-3' | (SEQ ID NO: 317) | |
| | 5'-GCCAAAAAACAAACAAACAAAAACAA-3' | (SEQ ID NO: 4518) | |
| | 3'-CGGUUUUUUGUUUGUUUGUUUUUGUU-5' | (SEQ ID NO: 165) | |
| AR-729 Target: | 5'-GCCAAAAAACAAACAAACAAAAACAA-3' | (SEQ ID NO: 318) | |
| | 5'-CCAAAAAACAAACAAACAAAAACAAA-3' | (SEQ ID NO: 4519) | |
| | 3'-GGUUUUUUGUUUGUUUGUUUUUGUUU-5' | (SEQ ID NO: 166) | |
| AR-730 Target: | 5'-CCAAAAAACAAACAAACAAAAACAAA-3' | (SEQ ID NO: 319) | |
| | 5'-ACAAACAAACAAAAACAAAAAGCCG-3' | (SEQ ID NO: 4520) | |
| | 3'-UGUUUGUUUGUUUUUGUUUUUUCGGC-5' | (SEQ ID NO: 167) | |
| AR-737 Target: | 5'-ACAAAACAAACAAAAACAAAAAGCCG-3' | (SEQ ID NO: 320) | |
| | 5'-AACAAAAACAAAAAGCCGAAAUAAAA-3' | (SEQ ID NO: 4521) | |
| | 3'-UUGUUUUUGUUUUUUCGGCUUUAUUUU-5' | (SEQ ID NO: 168) | |
| AR-745 Target: | 5'-AACAAAAACAAAAAGCCGAAATAAAA-3' | (SEQ ID NO: 321) | |
| | 5'-ACAAAAACAAAAAGCCGAAAUAAAAG-3' | (SEQ ID NO: 4522) | |
| | 3'-UGUUUUUGUUUUUUCGGCUUUAUUUUC-5' | (SEQ ID NO: 169) | |
| AR-746 Target: | 5'-ACAAAAACAAAAAGCCGAAATAAAAG-3' | (SEQ ID NO: 322) | |
| | 5'-CAAAAACAAAAAGCCGAAAUAAAAGA-3' | (SEQ ID NO: 4523) | |
| | 3'-GUUUUUGUUUUUUCGGCUUUAUUUUCU-5' | (SEQ ID NO: 170) | |
| AR-747 Target: | 5'-CAAAAACAAAAAGCCGAAATAAAAGA-3' | (SEQ ID NO: 323) | |
| | 5'-ACAAAAAGCCGAAAUAAAAGAAAAAG-3' | (SEQ ID NO: 4524) | |
| | 3'-UGUUUUUUCGGCUUUAUUUUCUUUUUC-5' | (SEQ ID NO: 171) | |
| AR-752 Target: | 5'-ACAAAAAGCCGAAATAAAAGAAAAAG-3' | (SEQ ID NO: 324) | |
| | 5'-CAAAAAGCCGAAAUAAAAGAAAAAGA-3' | (SEQ ID NO: 4525) | |
| | 3'-GUUUUUUCGGCUUUAUUUUCUUUUUCU-5' | (SEQ ID NO: 172) | |
| AR-753 Target: | 5'-CAAAAAGCCGAAATAAAAGAAAAAGA-3' | (SEQ ID NO: 325) | |
| | 5'-AAAAAGCCGAAAUAAAAGAAAAAGAUA-3' | (SEQ ID NO: 4526) | |
| | 3'-UUUUUCGGCUUUAUUUUCUUUUUCUAU-5' | (SEQ ID NO: 173) | |
| AR-755 Target: | 5'-AAAAAGCCGAAATAAAAGAAAAAGATA-3' | (SEQ ID NO: 326) | |
| | 5'-GCCGAAAUAAAAGAAAAAGAUAAUAAC-3' | (SEQ ID NO: 4527) | |
| | 3'-CGGCUUUAUUUUCUUUUUCUAUUAUUG-5' | (SEQ ID NO: 174) | |
| AR-760 Target: | 5'-GCCGAAATAAAAGAAAAAGATAATAAC-3' | (SEQ ID NO: 327) | |
| | 5'-CCGAAAUAAAAGAAAAAGAUAAUAACU-3' | (SEQ ID NO: 4528) | |
| | 3'-GGCUUUAUUUUCUUUUUCUAUUAUUGA-5' | (SEQ ID NO: 175) | |

TABLE 7-continued

Selected Human Anti-AR 27mer "Blunt/Blunt" DsiRNA Agents

```
AR-761 Target:   5'-CCGAAATAAAAGAAAAAGATAATAACT-3'    (SEQ ID NO: 328)

5'-CGAAAUAAAAGAAAAAGAUAAUAACUC-3'   (SEQ ID NO: 4529)
                 3'-GCUUUAUUUUCUUUUUCUAUUAUUGAG-5'   (SEQ ID NO: 176)

AR-762 Target:   5'-CGAAATAAAAGAAAAAGATAATAACTC-3'   (SEQ ID NO: 329)

5'-AAGAAAAGAUAAUAACUCAGUUCUUA-3'    (SEQ ID NO: 4530)
                 3'-UUCUUUUUCUAUUAUUGAGUCAAGAAU-5'   (SEQ ID NO: 177)

AR-770 Target:   5'-AAGAAAAGATAATAACTCAGTTCTTA-3'    (SEQ ID NO: 330)

5'-AAAAGAUAAUAACUCAGUUCUUAUUUG-3'   (SEQ ID NO: 4531)
                 3'-UUUUCUAUUAUUGAGUCAAGAAUAAAC-5'   (SEQ ID NO: 178)

AR-774 Target:   5'-AAAAGATAATAACTCAGTTCTTATTTG-3'   (SEQ ID NO: 331)

5'-AAAGAUAAUAACUCAGUUCUUAUUUGC-3'   (SEQ ID NO: 4532)
                 3'-UUUCUAUUAUUGAGUCAAGAAUAAACG-5'   (SEQ ID NO: 179)

AR-775 Target:   5'-AAAGATAATAACTCAGTTCTTATTTGC-3'   (SEQ ID NO: 332)

5'-AGAUAAUAACUCAGUUCUUAUUUGCAC-3'   (SEQ ID NO: 4533)
                 3'-UCUAUUAUUGAGUCAAGAAUAAACGUG-5'   (SEQ ID NO: 180)

AR-777 Target:   5'-AGATAATAACTCAGTTCTTATTTGCAC-3'   (SEQ ID NO: 333)

5'-GAUAAUAACUCAGUUCUUAUUUGCACC-3'   (SEQ ID NO: 4534)
                 3'-CUAUUAUUGAGUCAAGAAUAAACGUGG-5'   (SEQ ID NO: 181)

AR-778 Target:   5'-GATAATAACTCAGTTCTTATTTGCACC-3'   (SEQ ID NO: 334)

5'-UCUUAUUUGCACCUACUUCAGUGGACA-3'   (SEQ ID NO: 4535)
                 3'-AGAAUAAACGUGGAUGAAGUCACCUGU-5'   (SEQ ID NO: 182)

AR-792 Target:   5'-TCTTATTTGCACCTACTTCAGTGGACA-3'   (SEQ ID NO: 335)

5'-UCAGUGGACACUGAAUUUGGAAGGUGG-3'   (SEQ ID NO: 4536)
                 3'-AGUCACCUGUGACUUAAACCUUCCACC-5'   (SEQ ID NO: 183)

AR-809 Target:   5'-TCAGTGGACACTGAATTTGGAAGGTGG-3'   (SEQ ID NO: 336)

5'-CACUGAAUUUGGAAGGUGGAGGAUUUU-3'   (SEQ ID NO: 4537)
                 3'-GUGACUUAAACCUUCCACCUCCUAAAA-5'   (SEQ ID NO: 184)

AR-817 Target:   5'-CACTGAATTTGGAAGGTGGAGGATTTT-3'   (SEQ ID NO: 337)

5'-UUUGGAAGGUGGAGGAUUUUGUUUUUU-3'   (SEQ ID NO: 4538)
                 3'-AAACCUUCCACCUCCUAAAACAAAAAA-5'   (SEQ ID NO: 185)

AR-824 Target:   5'-TTTGGAAGGTGGAGGATTTTGTTTTTT-3'   (SEQ ID NO: 338)

5'-GGAAGGUGGAGGAUUUUGUUUUUUUCU-3'   (SEQ ID NO: 4539)
                 3'-CCUUCCACCUCCUAAAACAAAAAAAGA-5'   (SEQ ID NO: 186)

AR-827 Target:   5'-GGAAGGTGGAGGATTTTGTTTTTTTCT-3'   (SEQ ID NO: 339)

5'-UGGAGGAUUUUGUUUUUUUCUUUUAAG-3'   (SEQ ID NO: 4540)
                 3'-ACCUCCUAAAACAAAAAAAGAAAAUUC-5'   (SEQ ID NO: 187)

AR-833 Target:   5'-TGGAGGATTTTGTTTTTTTCTTTTAAG-3'   (SEQ ID NO: 340)

5'-GGAGGAUUUUGUUUUUUUCUUUUAAGA-3'   (SEQ ID NO: 4541)
                 3'-CCUCCUAAAACAAAAAAAGAAAAUUCU-5'   (SEQ ID NO: 188)

AR-834 Target:   5'-GGAGGATTTTGTTTTTTTCTTTTAAGA-3'   (SEQ ID NO: 341)

5'-AGGAUUUUGUUUUUUUCUUUUAAGAUC-3'   (SEQ ID NO: 4542)
                 3'-UCCUAAAACAAAAAAAGAAAAUUCUAG-5'   (SEQ ID NO: 189)

AR-836 Target:   5'-AGGATTTTGTTTTTTTCTTTTAAGATC-3'   (SEQ ID NO: 342)

5'-GGAUUUUGUUUUUUUCUUUUAAGAUCU-3'   (SEQ ID NO: 4543)
                 3'-CCUAAAACAAAAAAAGAAAAUUCUAGA-5'   (SEQ ID NO: 190)
```

TABLE 7-continued

Selected Human Anti-AR 27mer "Blunt/Blunt" DsiRNA Agents

```
AR-837 Target:    5'-GGATTTTGTTTTTTCTTTTAAGATCT-3'     (SEQ ID NO: 343)

5'-GAUUUUGUUUUUUCUUUUAAGAUCUG-3'    (SEQ ID NO: 4544)
                  3'-CUAAAACAAAAAAGAAAAUUCUAGAC-5'    (SEQ ID NO: 191)

AR-838 Target:    5'-GATTTTGTTTTTTCTTTTAAGATCTG-3'     (SEQ ID NO: 344)

5'-AUUUUGUUUUUUCUUUUAAGAUCUGG-3'    (SEQ ID NO: 4545)
                  3'-UAAAACAAAAAAGAAAAUUCUAGACC-5'    (SEQ ID NO: 192)

AR-839 Target:    5'-ATTTTGTTTTTTCTTTTAAGATCTGG-3'     (SEQ ID NO: 345)

5'-UGUUUUUUCUUUUAAGAUCUGGGCAU-3'    (SEQ ID NO: 4546)
                  3'-ACAAAAAAGAAAAUUCUAGACCCGUA-5'    (SEQ ID NO: 193)

AR-843 Target:    5'-TGTTTTTTCTTTTAAGATCTGGGCAT-3'     (SEQ ID NO: 346)

5'-GUUUUUUCUUUUAAGAUCUGGGCAUC-3'    (SEQ ID NO: 4547)
                  3'-CAAAAAAGAAAAUUCUAGACCCGUAG-5'    (SEQ ID NO: 194)

AR-844 Target:    5'-GTTTTTTCTTTTAAGATCTGGGCATC-3'     (SEQ ID NO: 347)

5'-UUUAAGAUCUGGGCAUCUUUUGAAUCU-3'   (SEQ ID NO: 4548)
                  3'-AAAUUCUAGACCCGUAGAAAACUUAGA-5'   (SEQ ID NO: 195)

AR-854 Target:    5'-TTTAAGATCTGGGCATCTTTTGAATCT-3'    (SEQ ID NO: 348)

5'-AUCUUUUGAAUCUACCCUUCAAGUAUU-3'   (SEQ ID NO: 4549)
                  3'-UAGAAAACUUAGAUGGGAAGUUCAUAA-5'   (SEQ ID NO: 196)

AR-868 Target:    5'-ATCTTTTGAATCTACCCTTCAAGTATT-3'    (SEQ ID NO: 349)

5'-UCUUUUGAAUCUACCCUUCAAGUAUUA-3'   (SEQ ID NO: 4550)
                  3'-AGAAAACUUAGAUGGGAAGUUCAUAAU-5'   (SEQ ID NO: 197)

AR-869 Target:    5'-TCTTTTGAATCTACCCTTCAAGTATTA-3'    (SEQ ID NO: 350)

5'-CUUUUGAAUCUACCCUUCAAGUAUUAA-3'   (SEQ ID NO: 4551)
                  3'-GAAAACUUAGAUGGGAAGUUCAUAAUU-5'   (SEQ ID NO: 198)

AR-870 Target:    5'-CTTTTGAATCTACCCTTCAAGTATTAA-3'    (SEQ ID NO: 351)

5'-UUUUGAAUCUACCCUUCAAGUAUUAAG-3'   (SEQ ID NO: 4552)
                  3'-AAAACUUAGAUGGGAAGUUCAUAAUUC-5'   (SEQ ID NO: 199)

AR-871 Target:    5'-TTTTGAATCTACCCTTCAAGTATTAAG-3'    (SEQ ID NO: 352)

5'-UUUGAAUCUACCCUUCAAGUAUUAAGA-3'   (SEQ ID NO: 4553)
                  3'-AAACUUAGAUGGGAAGUUCAUAAUUCU-5'   (SEQ ID NO: 200)

AR-872 Target:    5'-TTTGAATCTACCCTTCAAGTATTAAGA-3'    (SEQ ID NO: 353)

5'-UCAAGUAUUAAGAGACAGACUGUGAGC-3'   (SEQ ID NO: 4554)
                  3'-AGUUCAUAAUUCUCUGUCUGACACUCG-5'   (SEQ ID NO: 201)

AR-886 Target:    5'-TCAAGTATTAAGAGACAGACTGTGAGC-3'    (SEQ ID NO: 354)

5'-AGUAUUAAGAGACAGACUGUGAGCCUA-3'   (SEQ ID NO: 4555)
                  3'-UCAUAAUUCUCUGUCUGACACUCGGAU-5'   (SEQ ID NO: 202)

AR-889 Target:    5'-AGTATTAAGAGACAGACTGTGAGCCTA-3'    (SEQ ID NO: 355)

5'-CUGUUGAACUCUUCUGAGCAAGAGAAG-3'   (SEQ ID NO: 4556)
                  3'-GACAACUUGAGAAGACUCGUUCUCUUC-5'   (SEQ ID NO: 203)

AR-1067 Target:   5'-CTGTTGAACTCTTCTGAGCAAGAGAAG-3'    (SEQ ID NO: 356)

5'-UGUUGAACUCUUCUGAGCAAGAGAAGG-3'   (SEQ ID NO: 4557)
                  3'-ACAACUUGAGAAGACUCGUUCUCUUCC-5'   (SEQ ID NO: 204)

AR-1068 Target:   5'-TGTTGAACTCTTCTGAGCAAGAGAAGG-3'    (SEQ ID NO: 357)

5'-CAAGGAUGGAAGUGCAGUUAGGGCUGG-3'   (SEQ ID NO: 4558)
                  3'-GUUCCUACCUUCACGUCAAUCCCGACC-5'   (SEQ ID NO: 205)
```

TABLE 7-continued

Selected Human Anti-AR 27mer "Blunt/Blunt" DsiRNA Agents

```
AR-1137 Target:   5'-CAAGGATGGAAGTGCAGTTAGGGCTGG-3'    (SEQ ID NO: 358)

5'-CCGAGGAGCUUUCCAGAAUCUGUUCCA-3'   (SEQ ID NO: 4559)
                  3'-GGCUCCUCGAAAGGUCUUAGACAAGGU-5'   (SEQ ID NO: 206)

AR-1198 Target:   5'-CCGAGGAGCTTTCCAGAATCTGTTCCA-3'    (SEQ ID NO: 359)

5'-CGAGGAGCUUUCCAGAAUCUGUUCCAG-3'   (SEQ ID NO: 4560)
                  3'-GCUCCUCGAAAGGUCUUAGACAAGGUC-5'   (SEQ ID NO: 207)

AR-1199 Target:   5'-CGAGGAGCTTTCCAGAATCTGTTCCAG-3'    (SEQ ID NO: 360)

5'-CGCUGACCUUAAAGACAUCCUGAGCGA-3'   (SEQ ID NO: 4561)
                  3'-GCGACUGGAAUUUCUGUAGGACUCGCU-5'   (SEQ ID NO: 208)

AR-1675 Target:   5'-CGCTGACCTTAAAGACATCCTGAGCGA-3'    (SEQ ID NO: 361)

5'-UCCAAGGACAAUUACUUAGGGGGCACU-3'   (SEQ ID NO: 4562)
                  3'-AGGUUCCUGUUAAUGAAUCCCCCGUGA-5'   (SEQ ID NO: 209)

AR-1802 Target:   5'-TCCAAGGACAATTACTTAGGGGGCACT-3'    (SEQ ID NO: 362)

5'-CCAAGGAGUUGUGUAAGGCAGUGUCGG-3'   (SEQ ID NO: 4563)
                  3'-GGUUCCUCAACACAUUCCGUCACAGCC-5'   (SEQ ID NO: 210)

AR-1848 Target:   5'-CCAAGGAGTTGTGTAAGGCAGTGTCGG-3'    (SEQ ID NO: 363)

5'-CACUGAAGAUACUGCUGAGUAUUCCCC-3'   (SEQ ID NO: 4564)
                  3'-GUGACUUCUAUGACGACUCAUAAGGGG-5'   (SEQ ID NO: 211)

AR-2047 Target:   5'-CACTGAAGATACTGCTGAGTATTCCCC-3'    (SEQ ID NO: 364)

5'-UGCUGAGUAUUCCCCUUUCAAGGGAGG-3'   (SEQ ID NO: 4565)
                  3'-ACGACUCAUAAGGGGAAAGUUCCCUCC-5'   (SEQ ID NO: 212)

AR-2059 Target:   5'-TGCTGAGTATTCCCCTTTCAAGGGAGG-3'    (SEQ ID NO: 365)

5'-CACUUGUGUCAAAAGCGAAAUGGGCCC-3'   (SEQ ID NO: 4566)
                  3'-GUGAACACAGUUUUCGCUUUACCCGGG-5'   (SEQ ID NO: 213)

AR-2692 Target:   5'-CACTTGTGTCAAAAGCGAAATGGGCCC-3'    (SEQ ID NO: 366)

5'-ACUUGUGUCAAAAGCGAAAUGGGCCCC-3'   (SEQ ID NO: 4567)
                  3'-UGAACACAGUUUUCGCUUUACCCGGGG-5'   (SEQ ID NO: 214)

AR-2693 Target:   5'-ACTTGTGTCAAAAGCGAAATGGGCCCC-3'    (SEQ ID NO: 367)

5'-ACCAUGUUUUGCCCAUUGACUAUUACU-3'   (SEQ ID NO: 4568)
                  3'-UGGUACAAAACGGGUAACUGAUAAUGA-5'   (SEQ ID NO: 215)

AR-2775 Target:   5'-ACCATGTTTTGCCCATTGACTATTACT-3'    (SEQ ID NO: 368)

5'-CAUGUUUUGCCCAUUGACUAUUACUUU-3'   (SEQ ID NO: 4569)
                  3'-GUACAAAACGGGUAACUGAUAAUGAAA-5'   (SEQ ID NO: 216)

AR-2777 Target:   5'-CATGTTTTGCCCATTGACTATTACTTT-3'    (SEQ ID NO: 369)

5'-CUGUGGAGAUGAAGCUUCUGGGUGUCA-3'   (SEQ ID NO: 4570)
                  3'-GACACCUCUACUUCGAAGACCCACAGU-5'   (SEQ ID NO: 217)

AR-2827 Target:   5'-CTGTGGAGATGAAGCTTCTGGGTGTCA-3'    (SEQ ID NO: 370)

5'-UGAAGGGAAACAGAAGUACCUGUGCGC-3'   (SEQ ID NO: 4571)
                  3'-ACUUCCCUUUGUCUUCAUGGACACGCG-5'   (SEQ ID NO: 218)

AR-2905 Target:   5'-TGAAGGGAAACAGAAGTACCTGTGCGC-3'    (SEQ ID NO: 371)

5'-GCAGAAAUGAUUGCACUAUUGAUAAAU-3'   (SEQ ID NO: 4572)
                  3'-CGUCUUUACUAACGUGAUAACUAUUUA-5'   (SEQ ID NO: 219)

AR-2934 Target:   5'-GCAGAAATGATTGCACTATTGATAAAT-3'    (SEQ ID NO: 372)

5'-CAGAAAUGAUUGCACUAUUGAUAAAUU-3'   (SEQ ID NO: 4573)
                  3'-GUCUUUACUAACGUGAUAACUAUUUAA-5'   (SEQ ID NO: 220)
```

TABLE 7-continued

Selected Human Anti-AR 27mer "Blunt/Blunt" DsiRNA Agents

```
AR-2935 Target:  5'-CAGAAATGATTGCACTATTGATAAATT-3'    (SEQ ID NO: 373)

5'-AGAAAUGAUUGCACUAUUGAUAAAUUC-3'   (SEQ ID NO: 4574)
                 3'-UCUUUACUAACGUGAUAACUAUUUAAG-5'   (SEQ ID NO: 221)

AR-2936 Target:  5'-AGAAATGATTGCACTATTGATAAATTC-3'   (SEQ ID NO: 374)

5'-AAAUGAUUGCACUAUUGAUAAAUUCCG-3'   (SEQ ID NO: 4575)
                 3'-UUUACUAACGUGAUAACUAUUUAAGGC-5'   (SEQ ID NO: 222)

AR-2938 Target:  5'-AAATGATTGCACTATTGATAAATTCCG-3'   (SEQ ID NO: 375)

5'-AAUGAUUGCACUAUUGAUAAAUUCCGA-3'   (SEQ ID NO: 4576)
                 3'-UUACUAACGUGAUAACUAUUUAAGGCU-5'   (SEQ ID NO: 223)

AR-2939 Target:  5'-AATGATTGCACTATTGATAAATTCCGA-3'   (SEQ ID NO: 376)

5'-CACUAUUGAUAAAUUCCGAAGGAAAAA-3'   (SEQ ID NO: 4577)
                 3'-GUGAUAACUAUUUAAGGCUUCCUUUUU-5'   (SEQ ID NO: 224)

AR-2947 Target:  5'-CACTATTGATAAATTCCGAAGGAAAA-3'    (SEQ ID NO: 377)

5'-ACUAUUGAUAAAUUCCGAAGGAAAAAU-3'  (SEQ ID NO: 4578)
                 3'-UGAUAACUAUUUAAGGCUUCCUUUUUA-5'  (SEQ ID NO: 225)

AR-2948 Target:  5'-ACTATTGATAAATTCCGAAGGAAAAAT-3'   (SEQ ID NO: 378)

5'-CUAUUGAUAAAUUCCGAAGGAAAAAUU-3'  (SEQ ID NO: 4579)
                 3'-GAUAACUAUUUAAGGCUUCCUUUUUAA-5'  (SEQ ID NO: 226)

AR-2949 Target:  5'-CTATTGATAAATTCCGAAGGAAAAATT-3'   (SEQ ID NO: 379)

5'-UAUUGAUAAAUUCCGAAGGAAAAAUUG-3'  (SEQ ID NO: 4580)
                 3'-AUAACUAUUUAAGGCUUCCUUUUUAAC-5'  (SEQ ID NO: 227)

AR-2950 Target:  5'-TATTGATAAATTCCGAAGGAAAAATTG-3'   (SEQ ID NO: 380)

5'-AUUGAUAAAUUCCGAAGGAAAAAUUGU-3'  (SEQ ID NO: 4581)
                 3'-UAACUAUUUAAGGCUUCCUUUUUAACA-5'  (SEQ ID NO: 228)

AR-2951 Target:  5'-ATTGATAAATTCCGAAGGAAAAATTGT-3'   (SEQ ID NO: 381)

5'-UGAUAAAUUCCGAAGGAAAAAUUGUCC-3'  (SEQ ID NO: 4582)
                 3'-ACUAUUUAAGGCUUCCUUUUUAACAGG-5'  (SEQ ID NO: 229)

AR-2953 Target:  5'-TGATAAATTCCGAAGGAAAAATTGTCC-3'   (SEQ ID NO: 382)

5'-GAUAAAUUCCGAAGGAAAAAUUGUCCA-3'  (SEQ ID NO: 4583)
                 3'-CUAUUUAAGGCUUCCUUUUUAACAGGU-5'  (SEQ ID NO: 230)

AR-2954 Target:  5'-GATAAATTCCGAAGGAAAAATTGTCCA-3'   (SEQ ID NO: 383)

5'-CGAAGGAAAAAUUGUCCAUCUUGUCGU-3'  (SEQ ID NO: 4584)
                 3'-GCUUCCUUUUUAACAGGUAGAACAGCA-5'  (SEQ ID NO: 231)

AR-2963 Target:  5'-CGAAGGAAAAATTGTCCATCTTGTCGT-3'   (SEQ ID NO: 384)

5'-AUCUUGUCGUCUUCGGAAAUGUUAUGA-3'  (SEQ ID NO: 4585)
                 3'-UAGAACAGCAGAAGCCUUUACAAUACU-5'  (SEQ ID NO: 232)

AR-2980 Target:  5'-ATCTTGTCGTCTTCGGAAATGTTATGA-3'   (SEQ ID NO: 385)

5'-CGGAAAUGUUAUGAAGCAGGGAUGACU-3'  (SEQ ID NO: 4586)
                 3'-GCCUUUACAAUACUUCGUCCCUACUGA-5'  (SEQ ID NO: 233)

AR-2993 Target:  5'-CGGAAATGTTATGAAGCAGGGATGACT-3'   (SEQ ID NO: 386)

5'-GAAAUGUUAUGAAGCAGGGAUGACUCU-3'  (SEQ ID NO: 4587)
                 3'-CUUUACAAUACUUCGUCCCUACUGAGA-5'  (SEQ ID NO: 234)

AR-2995 Target:  5'-GAAATGTTATGAAGCAGGGATGACTCT-3'   (SEQ ID NO: 387)

5'-CCCGGAAGCUGAAGAAACUUGGUAAUC-3'  (SEQ ID NO: 4588)
                 3'-GGGCCUUCGACUUCUUUGAACCAUUAG-5'  (SEQ ID NO: 235)
```

TABLE 7-continued

Selected Human Anti-AR 27mer "Blunt/Blunt" DsiRNA Agents

```
AR-3027 Target:  5'-CCCGGAAGCTGAAGAAACTTGGTAATC-3'   (SEQ ID NO: 388)

5'-CGGAAGCUGAAGAAACUUGGUAAUCUG-3'   (SEQ ID NO: 4589)
                 3'-GCCUUCGACUUCUUUGAACCAUUAGAC-5'   (SEQ ID NO: 236)

AR-3029 Target:  5'-CGGAAGCTGAAGAAACTTGGTAATCTG-3'   (SEQ ID NO: 389)

5'-GCUGAAGAAACUUGGUAAUCUGAAACU-3'   (SEQ ID NO: 4590)
                 3'-CGACUUCUUUGAACCAUUAGACUUUGA-5'   (SEQ ID NO: 237)

AR-3034 Target:  5'-GCTGAAGAAACTTGGTAATCTGAAACT-3'   (SEQ ID NO: 390)

5'-CUGAAGAAACUUGGUAAUCUGAAACUA-3'   (SEQ ID NO: 4591)
                 3'-GACUUCUUUGAACCAUUAGACUUUGAU-5'   (SEQ ID NO: 238)

AR-3035 Target:  5'-CTGAAGAAACTTGGTAATCTGAAACTA-3'   (SEQ ID NO: 391)

5'-UGAAGAAACUUGGUAAUCUGAAACUAC-3'   (SEQ ID NO: 4592)
                 3'-ACUUCUUUGAACCAUUAGACUUUGAUG-5'   (SEQ ID NO: 239)

AR-3036 Target:  5'-TGAAGAAACTTGGTAATCTGAAACTAC-3'   (SEQ ID NO: 392)

5'-UUGGUAAUCUGAAACUACAGGAGGAAG-3'   (SEQ ID NO: 4593)
                 3'-AACCAUUAGACUUUGAUGUCCUCCUUC-5'   (SEQ ID NO: 240)

AR-3045 Target:  5'-TTGGTAATCTGAAACTACAGGAGGAAG-3'   (SEQ ID NO: 393)

5'-AUCUGAAACUACAGGAGGAAGGAGAGG-3'   (SEQ ID NO: 4594)
                 3'-UAGACUUUGAUGUCCUCCUUCCUCUCC-5'   (SEQ ID NO: 241)

AR-3051 Target:  5'-ATCTGAAACTACAGGAGGAAGGAGAGG-3'   (SEQ ID NO: 394)

5'-CCCAGGAAUUCCUGUGCAUGAAAGCAC-3'   (SEQ ID NO: 4595)
                 3'-GGGUCCUUAAGGACACGUACUUUCGUG-5'   (SEQ ID NO: 242)

AR-3546 Target:  5'-CCCAGGAATTCCTGTGCATGAAAGCAC-3'   (SEQ ID NO: 395)

5'-CCAGGAAUUCCUGUGCAUGAAAGCACU-3'   (SEQ ID NO: 4596)
                 3'-GGUCCUUAAGGACACGUACUUUCGUGA-5'   (SEQ ID NO: 243)

AR-3547 Target:  5'-CCAGGAATTCCTGTGCATGAAAGCACT-3'   (SEQ ID NO: 396)

5'-GUGGAUGGGCUGAAAAAUCAAAAAUUC-3'   (SEQ ID NO: 4597)
                 3'-CACCUACCCGACUUUUUAGUUUUUAAG-5'   (SEQ ID NO: 244)

AR-3596 Target:  5'-GTGGATGGGCTGAAAAATCAAAAATTC-3'   (SEQ ID NO: 397)

5'-UGGAUGGGCUGAAAAAUCAAAAAUUCU-3'   (SEQ ID NO: 4598)
                 3'-ACCUACCCGACUUUUUAGUUUUUAAGA-5'   (SEQ ID NO: 245)

AR-3597 Target:  5'-TGGATGGGCTGAAAAATCAAAAATTCT-3'   (SEQ ID NO: 398)

5'-GAUGGGCUGAAAAAUCAAAAAUUCUUU-3'   (SEQ ID NO: 4599)
                 3'-CUACCCGACUUUUUAGUUUUUAAGAAA-5'   (SEQ ID NO: 246)

AR-3599 Target:  5'-GATGGGCTGAAAAATCAAAAATTCTTT-3'   (SEQ ID NO: 399)

5'-GGCUGAAAAAUCAAAAAUUCUUUGAUG-3'   (SEQ ID NO: 4600)
                 3'-CCGACUUUUUAGUUUUUAAGAAACUAC-5'   (SEQ ID NO: 247)

AR-3603 Target:  5'-GGCTGAAAAATCAAAAATTCTTTGATG-3'   (SEQ ID NO: 400)

5'-GCUGAAAAAUCAAAAAUUCUUUGAUGA-3'   (SEQ ID NO: 4601)
                 3'-CGACUUUUUAGUUUUUAAGAAACUACU-5'   (SEQ ID NO: 248)

AR-3604 Target:  5'-GCTGAAAAATCAAAAATTCTTTGATGA-3'   (SEQ ID NO: 401)

5'-UGAAAAAUCAAAAAUUCUUUGAUGAAC-3'   (SEQ ID NO: 4602)
                 3'-ACUUUUUAGUUUUUAAGAAACUACUUG-5'   (SEQ ID NO: 249)

AR-3606 Target:  5'-TGAAAAATCAAAAATTCTTTGATGAAC-3'   (SEQ ID NO: 402)

5'-GAAAAAUCAAAAAUUCUUUGAUGAACU-3'   (SEQ ID NO: 4603)
                 3'-CUUUUUAGUUUUUAAGAAACUACUUGA-5'   (SEQ ID NO: 250)
```

TABLE 7-continued

Selected Human Anti-AR 27mer "Blunt/Blunt" DsiRNA Agents

```
AR-3607 Target:  5'-GAAAAATCAAAAATTCTTTGATGAACT-3'   (SEQ ID NO: 403)

5'-AAAAAUCAAAAAUUCUUUGAUGAACUU-3'  (SEQ ID NO: 4604)
                 3'-UUUUUAGUUUUUAAGAAACUACUUGAA-5'  (SEQ ID NO: 251)

AR-3608 Target:  5'-AAAAATCAAAAATTCTTTGATGAACTT-3'   (SEQ ID NO: 404)

5'-UUCGAAUGAACUACAUCAAGGAACUCG-3'  (SEQ ID NO: 4605)
                 3'-AAGCUUACUUGAUGUAGUUCCUUGAGC-5'  (SEQ ID NO: 252)

AR-3633 Target:  5'-TTCGAATGAACTACATCAAGGAACTCG-3'   (SEQ ID NO: 405)

5'-UCAAGGAACUCGAUCGUAUCAUUGCAU-3'  (SEQ ID NO: 4606)
                 3'-AGUUCCUUGAGCUAGCAUAGUAACGUA-5'  (SEQ ID NO: 253)

AR-3648 Target:  5'-TCAAGGAACTCGATCGTATCATTGCAT-3'   (SEQ ID NO: 406)

5'-CAAGGAACUCGAUCGUAUCAUUGCAUG-3'  (SEQ ID NO: 4607)
                 3'-GUUCCUUGAGCUAGCAUAGUAACGUAC-5'  (SEQ ID NO: 254)

AR-3649 Target:  5'-CAAGGAACTCGATCGTATCATTGCATG-3'   (SEQ ID NO: 407)

5'-AUCGUAUCAUUGCAUGCAAAAGAAAAA-3'  (SEQ ID NO: 4608)
                 3'-UAGCAUAGUAACGUACGUUUUCUUUUU-5'  (SEQ ID NO: 255)

AR-3660 Target:  5'-ATCGTATCATTGCATGCAAAAGAAAAA-3'   (SEQ ID NO: 408)

5'-UCGUAUCAUUGCAUGCAAAAGAAAAAA-3'  (SEQ ID NO: 4609)
                 3'-AGCAUAGUAACGUACGUUUUCUUUUUU-5'  (SEQ ID NO: 256)

AR-3661 Target:  5'-TCGTATCATTGCATGCAAAAGAAAAAA-3'   (SEQ ID NO: 409)

5'-AUCAUUGCAUGCAAAAGAAAAAAUCCC-3'  (SEQ ID NO: 4610)
                 3'-UAGUAACGUACGUUUUCUUUUUUAGGG-5'  (SEQ ID NO: 257)

AR-3665 Target:  5'-ATCATTGCATGCAAAAGAAAAAATCCC-3'   (SEQ ID NO: 410)

5'-CACUUUUGACCUGCUAAUCAAGUCACA-3'  (SEQ ID NO: 4611)
                 3'-GUGAAAACUGGACGAUUAGUUCAGUGU-5'  (SEQ ID NO: 258)

AR-3772 Target:  5'-CACTTTTGACCTGCTAATCAAGTCACA-3'   (SEQ ID NO: 411)

5'-GCGUGGACUUUCCGGAAAUGAUGGCAG-3'  (SEQ ID NO: 4612)
                 3'-CGCACCUGAAAGGCCUUUACUACCGUC-5'  (SEQ ID NO: 259)

AR-3807 Target:  5'-GCGTGGACTTTCCGGAAATGATGGCAG-3'   (SEQ ID NO: 412)

5'-CGUGGACUUUCCGGAAAUGAUGGCAGA-3'  (SEQ ID NO: 4613)
                 3'-GCACCUGAAAGGCCUUUACUACCGUCU-5'  (SEQ ID NO: 260)

AR-3808 Target:  5'-CGTGGACTTTCCGGAAATGATGGCAGA-3'   (SEQ ID NO: 413)

5'-UGAUGGCAGAGAUCAUCUCUGUGCAAG-3'  (SEQ ID NO: 4614)
                 3'-ACUACCGUCUCUAGUAGAGACACGUUC-5'  (SEQ ID NO: 261)

AR-3825 Target:  5'-TGATGGCAGAGATCATCTCTGTGCAAG-3'   (SEQ ID NO: 414)

5'-GCAGAGAUCAUCUCUGUGCAAGUGCCC-3'  (SEQ ID NO: 4615)
                 3'-CGUCUCUAGUAGAGACACGUUCACGGG-5'  (SEQ ID NO: 262)

AR-3830 Target:  5'-GCAGAGATCATCTCTGTGCAAGTGCCC-3'   (SEQ ID NO: 415)

5'-CAGAGAUCAUCUCUGUGCAAGUGCCCA-3'  (SEQ ID NO: 4616)
                 3'-GUCUCUAGUAGAGACACGUUCACGGGU-5'  (SEQ ID NO: 263)

AR-3831 Target:  5'-CAGAGATCATCTCTGTGCAAGTGCCCA-3'   (SEQ ID NO: 416)

5'-CCCAAGAUCCUUUCUGGGAAAGUCAAG-3'  (SEQ ID NO: 4617)
                 3'-GGGUUCUAGGAAAGACCCUUUCAGUUC-5'  (SEQ ID NO: 264)

AR-3854 Target:  5'-CCCAAGATCCTTTCTGGGAAAGTCAAG-3'   (SEQ ID NO: 417)

5'-GUGAAGCAUUGGAAACCCUAUUUCCCC-3'  (SEQ ID NO: 4618)
                 3'-CACUUCGUAACCUUUGGGAUAAAGGGG-5'  (SEQ ID NO: 265)
```

TABLE 7-continued

Selected Human Anti-AR 27mer "Blunt/Blunt" DsiRNA Agents

```
AR-3901 Target:  5'-GTGAAGCATTGGAAACCCTATTTCCCC-3'    (SEQ ID NO: 418)

5'-CAGAUGUCUUCUGCCUGUUAUAACUCU-3'    (SEQ ID NO: 4619)
                 3'-GUCUACAGAAGACGGACAAUAUUGAGA-5'    (SEQ ID NO: 266)

AR-3949 Target:  5'-CAGATGTCTTCTGCCTGTTATAACTCT-3'    (SEQ ID NO: 419)

5'-GCCUUGGGGAAUUUCCUCUAUUGAUGU-3'    (SEQ ID NO: 4620)
                 3'-CGGAACCCCUUAAAGGAGAUAACUACA-5'    (SEQ ID NO: 267)

AR-3994 Target:  5'-GCCTTGGGGAATTTCCTCTATTGATGT-3'    (SEQ ID NO: 420)

5'-CUUGGGGAAUUUCCUCUAUUGAUGUAC-3'    (SEQ ID NO: 4621)
                 3'-GAACCCCUUAAAGGAGAUAACUACAUG-5'    (SEQ ID NO: 268)

AR-3996 Target:  5'-CTTGGGGAATTTCCTCTATTGATGTAC-3'    (SEQ ID NO: 421)

5'-UUGGGGAAUUUCCUCUAUUGAUGUACA-3'    (SEQ ID NO: 4622)
                 3'-AACCCCUUAAAGGAGAUAACUACAUGU-5'    (SEQ ID NO: 269)

AR-3997 Target:  5'-TTGGGGAATTTCCTCTATTGATGTACA-3'    (SEQ ID NO: 422)

5'-UGGGGAAUUUCCUCUAUUGAUGUACAG-3'    (SEQ ID NO: 4623)
                 3'-ACCCCUUAAAGGAGAUAACUACAUGUC-5'    (SEQ ID NO: 270)

AR-3998 Target:  5'-TGGGGAATTTCCTCTATTGATGTACAG-3'    (SEQ ID NO: 423)

5'-GGGGAAUUUCCUCUAUUGAUGUACAGU-3'    (SEQ ID NO: 4624)
                 3'-CCCCUUAAAGGAGAUAACUACAUGUCA-5'    (SEQ ID NO: 271)

AR-3999 Target:  5'-GGGGAATTTCCTCTATTGATGTACAGT-3'    (SEQ ID NO: 424)

5'-CUAUUGAUGUACAGUCUGUCAUGAACA-3'    (SEQ ID NO: 4625)
                 3'-GAUAACUACAUGUCAGACAGUACUUGU-5'    (SEQ ID NO: 272)

AR-4011 Target:  5'-CTATTGATGTACAGTCTGTCATGAACA-3'    (SEQ ID NO: 425)

5'-UAUUGAUGUACAGUCUGUCAUGAACAU-3'    (SEQ ID NO: 4626)
                 3'-AUAACUACAUGUCAGACAGUACUUGUA-5'    (SEQ ID NO: 273)

AR-4012 Target:  5'-TATTGATGTACAGTCTGTCATGAACAT-3'    (SEQ ID NO: 426)

5'-AUUGAUGUACAGUCUGUCAUGAACAUG-3'    (SEQ ID NO: 4627)
                 3'-UAACUACAUGUCAGACAGUACUUGUAC-5'    (SEQ ID NO: 274)

AR-4013 Target:  5'-ATTGATGTACAGTCTGTCATGAACATG-3'    (SEQ ID NO: 427)

5'-AACAUGUUCCUGAAUUCUAUUUGCUGG-3'    (SEQ ID NO: 4628)
                 3'-UUGUACAAGGACUUAAGAUAAACGACC-5'    (SEQ ID NO: 275)

AR-4034 Target:  5'-AACATGTTCCTGAATTCTATTTGCTGG-3'    (SEQ ID NO: 428)

5'-UUCUAUUUGCUGGGCUUUUUUUUCUC-3'     (SEQ ID NO: 4629)
                 3'-AAGAUAAACGACCCGAAAAAAAAGAG-5'     (SEQ ID NO: 276)

AR-4048 Target:  5'-TTCTATTTGCTGGGCTTTTTTTTCTC-3'     (SEQ ID NO: 429)

5'-UCUAUUUGCUGGGCUUUUUUUUCUCU-3'    (SEQ ID NO: 4630)
                 3'-AGAUAAACGACCCGAAAAAAAAGAGA-5'    (SEQ ID NO: 277)

AR-4049 Target:  5'-TCTATTTGCTGGGCTTTTTTTTCTCT-3'    (SEQ ID NO: 430)

5'-UGCUGGGCUUUUUUUUCUCUUUCUCU-3'    (SEQ ID NO: 4631)
                 3'-ACGACCCGAAAAAAAAGAGAAAGAGA-5'    (SEQ ID NO: 278)

AR-4055 Target:  5'-TGCTGGGCTTTTTTTTCTCTTTCTCT-3'    (SEQ ID NO: 431)

5'-UUUUUUUUCUCUUUCUCUCCUUUCUUU-3'   (SEQ ID NO: 4632)
                 3'-AAAAAAAAGAGAAAGAGAGGAAAGAAA-5'   (SEQ ID NO: 279)

AR-4064 Target:  5'-TTTTTTTTCTCTTTCTCTCCTTTCTTT-3'   (SEQ ID NO: 432)

5'-UUCAGACUUUGCUUCCCAUUGUGGCUC-3'   (SEQ ID NO: 4633)
                 3'-AAGUCUGAAACGAAGGGUAACACCGAG-5'   (SEQ ID NO: 280)
```

TABLE 7-continued

Selected Human Anti-AR 27mer "Blunt/Blunt" DsiRNA Agents

```
AR-4128 Target:  5'-TTCAGACTTTGCTTCCCATTGTGGCTC-3'    (SEQ ID NO: 433)

5'-UUGUGGCUCCUAUCUGUGUUUUGAAUG-3'   (SEQ ID NO: 4634)
                 3'-AACACCGAGGAUAGACACAAAACUUAC-5'   (SEQ ID NO: 281)

AR-4146 Target:  5'-TTGTGGCTCCTATCTGTGTTTTGAATG-3'    (SEQ ID NO: 434)

5'-UCCUAUCUGUGUUUUGAAUGGUGUUGU-3'   (SEQ ID NO: 4635)
                 3'-AGGAUAGACACAAAACUUACCACAACA-5'   (SEQ ID NO: 282)

AR-4153 Target:  5'-TCCTATCTGTGTTTTGAATGGTGTTGT-3'    (SEQ ID NO: 435)

5'-AUCUGUGUUUUGAAUGGUGUUGUAUGC-3'   (SEQ ID NO: 4636)
                 3'-UAGACACAAAACUUACCACAACAUACG-5'   (SEQ ID NO: 283)

AR-4157 Target:  5'-ATCTGTGTTTTGAATGGTGTTGTATGC-3'    (SEQ ID NO: 436)

5'-UGUGUUUUGAAUGGUGUUGUAUGCCUU-3'   (SEQ ID NO: 4637)
                 3'-ACACAAAACUUACCACAACAUACGGAA-5'   (SEQ ID NO: 284)

AR-4160 Target:  5'-TGTGTTTTGAATGGTGTTGTATGCCTT-3'    (SEQ ID NO: 437)

5'-UGAAUGGUGUUGUAUGCCUUUAAAUCU-3'   (SEQ ID NO: 4638)
                 3'-ACUUACCACAACAUACGGAAAUUUAGA-5'   (SEQ ID NO: 285)

AR-4167 Target:  5'-TGAATGGTGTTGTATGCCTTTAAATCT-3'    (SEQ ID NO: 438)

5'-GAAUGGUGUUGUAUGCCUUUAAAUCUG-3'   (SEQ ID NO: 4639)
                 3'-CUUACCACAACAUACGGAAAUUUAGAC-5'   (SEQ ID NO: 286)

AR-4168 Target:  5'-GAATGGTGTTGTATGCCTTTAAATCTG-3'    (SEQ ID NO: 439)

5'-UGUUGUAUGCCUUUAAAUCUGUGAUGA-3'   (SEQ ID NO: 4640)
                 3'-ACAACAUACGGAAAUUUAGACACUACU-5'   (SEQ ID NO: 287)

AR-4174 Target:  5'-TGTTGTATGCCTTTAAATCTGTGATGA-3'    (SEQ ID NO: 440)

5'-UUGUAUGCCUUUAAAUCUGUGAUGAUC-3'   (SEQ ID NO: 4641)
                 3'-AACAUACGGAAAUUUAGACACUACUAG-5'   (SEQ ID NO: 288)

AR-4176 Target:  5'-TTGTATGCCTTTAAATCTGTGATGATC-3'    (SEQ ID NO: 441)

5'-UGUAUGCCUUUAAAUCUGUGAUGAUCC-3'   (SEQ ID NO: 4642)
                 3'-ACAUACGGAAAUUUAGACACUACUAGG-5'   (SEQ ID NO: 289)

AR-4177 Target:  5'-TGTATGCCTTTAAATCTGTGATGATCC-3'    (SEQ ID NO: 442)

5'-CCCAGUGUCAAGUUGUGCUUGUUUACA-3'   (SEQ ID NO: 4643)
                 3'-GGGUCACAGUUCAACACGAACAAAUGU-5'   (SEQ ID NO: 290)

AR-4212 Target:  5'-CCCAGTGTCAAGTTGTGCTTGTTTACA-3'    (SEQ ID NO: 443)

5'-CCAGUGUCAAGUUGUGCUUGUUUACAG-3'   (SEQ ID NO: 4644)
                 3'-GGUCACAGUUCAACACGAACAAAUGUC-5'   (SEQ ID NO: 291)

AR-4213 Target:  5'-CCAGTGTCAAGTTGTGCTTGTTTACAG-3'    (SEQ ID NO: 444)

5'-GCUUGUUUACAGCACUACUCUGUGCCA-3'   (SEQ ID NO: 4645)
                 3'-CGAACAAAUGUCGUGAUGAGACACGGU-5'   (SEQ ID NO: 292)

AR-4228 Target:  5'-GCTTGTTTACAGCACTACTCTGTGCCA-3'    (SEQ ID NO: 445)

5'-CUUGUUUACAGCACUACUCUGUGCCAG-3'   (SEQ ID NO: 4646)
                 3'-GAACAAAUGUCGUGAUGAGACACGGUC-5'   (SEQ ID NO: 293)

AR-4229 Target:  5'-CTTGTTTACAGCACTACTCTGTGCCAG-3'    (SEQ ID NO: 446)

5'-CACAAACGUUUACUUAUCUUAUGCCAC-3'   (SEQ ID NO: 4647)
                 3'-GUGUUUGCAAAUGAAUAGAAUACGGUG-5'   (SEQ ID NO: 294)

AR-4259 Target:  5'-CACAAACGTTTACTTATCTTATGCCAC-3'    (SEQ ID NO: 447)

5'-CACGGGAAGUUUAGAGAGCUAAGAUUA-3'   (SEQ ID NO: 4648)
                 3'-GUGCCCUUCAAAUCUCUCGAUUCUAAU-5'   (SEQ ID NO: 295)
```

TABLE 7-continued

Selected Human Anti-AR 27mer "Blunt/Blunt" DsiRNA Agents

```
AR-4283 Target:  5'-CACGGGAAGTTTAGAGAGCTAAGATTA-3'      (SEQ ID NO: 448)

5'-ACGGGAAGUUUAGAGAGCUAAGAUUAU-3'     (SEQ ID NO: 4649)
                 3'-UGCCCUUCAAAUCUCUCGAUUCUAAUA-5'     (SEQ ID NO: 296)

AR-4284 Target:  5'-ACGGGAAGTTTAGAGAGCTAAGATTAT-3'     (SEQ ID NO: 449)

5'-CGGGAAGUUUAGAGAGCUAAGAUUAUC-3'     (SEQ ID NO: 4650)
                 3'-GCCCUUCAAAUCUCUCGAUUCUAAUAG-5'     (SEQ ID NO: 297)

AR-4285 Target:  5'-CGGGAAGTTTAGAGAGCTAAGATTATC-3'     (SEQ ID NO: 450)

5'-GGGAAGUUUAGAGAGCUAAGAUUAUCU-3'     (SEQ ID NO: 4651)
                 3'-CCCUUCAAAUCUCUCGAUUCUAAUAGA-5'     (SEQ ID NO: 298)

AR-4286 Target:  5'-GGGAAGTTTAGAGAGCTAAGATTATCT-3'     (SEQ ID NO: 451)

5'-GAAGUUUAGAGAGCUAAGAUUAUCUGG-3'     (SEQ ID NO: 4652)
                 3'-CUUCAAAUCUCUCGAUUCUAAUAGACC-5'     (SEQ ID NO: 299)

AR-4288 Target:  5'-GAAGTTTAGAGAGCTAAGATTATCTGG-3'     (SEQ ID NO: 452)

5'-UUAGAGAGCUAAGAUUAUCUGGGGAAA-3'     (SEQ ID NO: 4653)
                 3'-AAUCUCUCGAUUCUAAUAGACCCCUUU-5'     (SEQ ID NO: 300)

AR-4293 Target:  5'-TTAGAGAGCTAAGATTATCTGGGGAAA-3'     (SEQ ID NO: 453)

5'-UAGAGAGCUAAGAUUAUCUGGGGAAAU-3'     (SEQ ID NO: 4654)
                 3'-AUCUCUCGAUUCUAAUAGACCCCUUUA-5'     (SEQ ID NO: 301)

AR-4294 Target:  5'-TAGAGAGCTAAGATTATCTGGGGAAAT-3'     (SEQ ID NO: 454)

5'-AGAGAGCUAAGAUUAUCUGGGGAAAUC-3'     (SEQ ID NO: 4655)
                 3'-UCUCUCGAUUCUAAUAGACCCCUUUAG-5'     (SEQ ID NO: 302)

AR-4295 Target:  5'-AGAGAGCTAAGATTATCTGGGGAAATC-3'     (SEQ ID NO: 455)

5'-UAAGAUUAUCUGGGGAAAUCAAAACAA-3'     (SEQ ID NO: 4656)
                 3'-AUUCUAAUAGACCCCUUUAGUUUUGUU-5'     (SEQ ID NO: 303)

AR-4302 Target:  5'-TAAGATTATCTGGGGAAATCAAAACAA-3'     (SEQ ID NO: 456)

5'-AAGAUUAUCUGGGGAAAUCAAAACAAA-3'     (SEQ ID NO: 4657)
                 3'-UUCUAAUAGACCCCUUUAGUUUUGUUU-5'     (SEQ ID NO: 304)

AR-4303 Target:  5'-AAGATTATCTGGGGAAATCAAAACAAA-3'     (SEQ ID NO: 457)

5'-AUCUGGGGAAAUCAAAACAAAAACAAG-3'     (SEQ ID NO: 4658)
                 3'-UAGACCCCUUUAGUUUUGUUUUUGUUC-5'     (SEQ ID NO: 305)

AR-4309 Target:  5'-ATCTGGGGAAATCAAAACAAAAACAAG-3'     (SEQ ID NO: 458)

5'-GGGGAAAUCAAAACAAAAACAAGCAAA-3'     (SEQ ID NO: 4659)
                 3'-CCCCUUUAGUUUUGUUUUUGUUCGUUU-5'     (SEQ ID NO: 306)

AR-4313 Target:  5'-GGGGAAATCAAAACAAAAACAAGCAAA-3'     (SEQ ID NO: 459)

5'-GUGAAGUUUUUAAAAGCUGCUAAAGAC-3'     (SEQ ID NO: 4660)
                 3'-CACUUCAAAAAUUUUCGACGAUUUCUG-5'     (SEQ ID NO: 796)

AR-251 Target:   5'-GTGAAGTTTTTAAAAGCTGCTAAAGAC-3'     (SEQ ID NO: 826)

5'-AGCUAGCUGCACAUUGCAAAGAAGGCU-3'     (SEQ ID NO: 4661)
                 3'-UCGAUCGACGUGUAACGUUUCUUCCGA-5'     (SEQ ID NO: 797)

AR-524 Target:   5'-AGCTAGCTGCACATTGCAAAGAAGGCT-3'     (SEQ ID NO: 827)

5'-ACAUUGCAAAGAAGGCUCUUAGGAGCC-3'     (SEQ ID NO: 4662)
                 3'-UGUAACGUUUCUUCCGAGAAUCCUCGG-5'     (SEQ ID NO: 798)

AR-534 Target:   5'-ACATTGCAAAGAAGGCTCTTAGGAGCC-3'     (SEQ ID NO: 828)

5'-AACAAAACAAACAAAAACAAAAAAGCC-3'     (SEQ ID NO: 4663)
                 3'-UUGUUUUGUUUGUUUUUGUUUUUUCGG-5'     (SEQ ID NO: 799)
```

TABLE 7-continued

Selected Human Anti-AR 27mer "Blunt/Blunt" DsiRNA Agents

| | | | |
|---|---|---|---|
| AR-736 Target: | 5'-AACAAAACAAACAAAAACAAAAAAGCC-3' | (SEQ ID NO: 829) | |
| | 5'-AAGAUAAUAACUCAGUUCUUAUUUGCA-3' | (SEQ ID NO: 4664) | |
| | 3'-UUCUAUUAUUGAGUCAAGAAUAAACGU-5' | (SEQ ID NO: 800) | |
| AR-776 Target: | 5'-AAGATAATAACTCAGTTCTTATTTGCA-3' | (SEQ ID NO: 830) | |
| | 5'-UUCAGUGGACACUGAAUUUGGAAGGUG-3' | (SEQ ID NO: 4665) | |
| | 3'-AAGUCACCUGUGACUUAAACCUUCCAC-5' | (SEQ ID NO: 801) | |
| AR-808 Target: | 5'-TTCAGTGGACACTGAATTTGGAAGGTG-3' | (SEQ ID NO: 831) | |
| | 5'-CAGUGGACACUGAAUUUGGAAGGUGGA-3' | (SEQ ID NO: 4666) | |
| | 3'-GUCACCUGUGACUUAAACCUUCCACCU-5' | (SEQ ID NO: 802) | |
| AR-810 Target: | 5'-CAGTGGACACTGAATTTGGAAGGTGGA-3' | (SEQ ID NO: 832) | |
| | 5'-AGUGGACACUGAAUUUGGAAGGUGGAG-3' | (SEQ ID NO: 4667) | |
| | 3'-UCACCUGUGACUUAAACCUUCCACCUC-5' | (SEQ ID NO: 803) | |
| AR-811 Target: | 5'-AGTGGACACTGAATTTGGAAGGTGGAG-3' | (SEQ ID NO: 833) | |
| | 5'-UUGAAUCUACCCUUCAAGUAUUAAGAG-3' | (SEQ ID NO: 4668) | |
| | 3'-AACUUAGAUGGGAAGUUCAUAAUUCUC-5' | (SEQ ID NO: 804) | |
| AR-873 Target: | 5'-TTGAATCTACCCTTCAAGTATTAAGAG-3' | (SEQ ID NO: 834) | |
| | 5'-CAAGUAUUAAGAGACAGACUGUGAGCC-3' | (SEQ ID NO: 4669) | |
| | 3'-GUUCAUAAUUCUCUGUCUGACACUCGG-5' | (SEQ ID NO: 805) | |
| AR-887 Target: | 5'-CAAGTATTAAGAGACAGACTGTGAGCC-3' | (SEQ ID NO: 835) | |
| | 5'-GCUGAGUAUUCCCCUUUCAAGGGAGGU-3' | (SEQ ID NO: 4670) | |
| | 3'-CGACUCAUAAGGGGAAAGUUCCCUCCA-5' | (SEQ ID NO: 806) | |
| AR-2060 Target: | 5'-GCTGAGTATTCCCCTTTCAAGGGAGGT-3' | (SEQ ID NO: 836) | |
| | 5'-CUGAGUAUUCCCCUUUCAAGGGAGGUU-3' | (SEQ ID NO: 4671) | |
| | 3'-GACUCAUAAGGGGAAAGUUCCCUCCAA-5' | (SEQ ID NO: 807) | |
| AR-2061 Target: | 5'-CTGAGTATTCCCCTTTCAAGGGAGGTT-3' | (SEQ ID NO: 837) | |
| | 5'-UCUGUGGAGAUGAAGCUUCUGGGUGUC-3' | (SEQ ID NO: 4672) | |
| | 3'-AGACACCUCUACUUCGAAGACCCACAG-5' | (SEQ ID NO: 808) | |
| AR-2826 Target: | 5'-TCTGTGGAGATGAAGCTTCTGGGTGTC-3' | (SEQ ID NO: 838) | |
| | 5'-GAAGGGAAACAGAAGUACCUGUGCGCC-3' | (SEQ ID NO: 4673) | |
| | 3'-CUUCCCUUUGUCUUCAUGGACACGCGG-5' | (SEQ ID NO: 809) | |
| AR-2906 Target: | 5'-GAAGGGAAACAGAAGTACCTGTGCGCC-3' | (SEQ ID NO: 839) | |
| | 5'-UUGAUAAAUUCCGAAGGAAAAAUUGUC-3' | (SEQ ID NO: 4674) | |
| | 3'-AACUAUUUAAGGCUUCCUUUUUAACAG-5' | (SEQ ID NO: 810) | |
| AR-2952 Target: | 5'-TTGATAAATTCCGAAGGAAAAATTGTC-3' | (SEQ ID NO: 840) | |
| | 5'-GAAGGAAAAAUUGUCCAUCUUGUCGUC-3' | (SEQ ID NO: 4675) | |
| | 3'-CUUCCUUUUUAACAGGUAGAACAGCAG-5' | (SEQ ID NO: 811) | |
| AR-2964 Target: | 5'-GAAGGAAAAATTGTCCATCTTGTCGTC-3' | (SEQ ID NO: 841) | |
| | 5'-UCGGAAAUGUUAUGAAGCAGGGAUGAC-3' | (SEQ ID NO: 4676) | |
| | 3'-AGCCUUUACAAUACUUCGUCCCUACUG-5' | (SEQ ID NO: 812) | |
| AR-2992 Target: | 5'-TCGGAAATGTTATGAAGCAGGGATGAC-3' | (SEQ ID NO: 842) | |
| | 5'-ACUUGGUAAUCUGAAACUACAGGAGGA-3' | (SEQ ID NO: 4677) | |
| | 3'-UGAACCAUUAGACUUUGAUGUCCUCCU-5' | (SEQ ID NO: 813) | |
| AR-3043 Target: | 5'-ACTTGGTAATCTGAAACTACAGGAGGA-3' | (SEQ ID NO: 843) | |
| | 5'-CUUGGUAAUCUGAAACUACAGGAGGAA-3' | (SEQ ID NO: 4678) | |
| | 3'-GAACCAUUAGACUUUGAUGUCCUCCUU-5' | (SEQ ID NO: 814) | |

TABLE 7-continued

Selected Human Anti-AR 27mer "Blunt/Blunt" DsiRNA Agents

```
AR-3044 Target:   5'-CTTGGTAATCTGAAACTACAGGAGGAA-3'    (SEQ ID NO: 844)

5'-GGUAAUCUGAAACUACAGGAGGAAGGA-3'   (SEQ ID NO: 4679)
                  3'-CCAUUAGACUUUGAUGUCCUCCUUCCU-5'   (SEQ ID NO: 815)

AR-3047 Target:   5'-GGTAATCTGAAACTACAGGAGGAAGGA-3'    (SEQ ID NO: 845)

5'-AGCUGACAGUGUCACACAUUGAAGGCU-3'   (SEQ ID NO: 4680)
                  3'-UCGACUGUCACAGUGUGUAACUUCCGA-5'   (SEQ ID NO: 816)

AR-3117 Target:   5'-AGCTGACAGTGTCACACATTGAAGGCT-3'    (SEQ ID NO: 846)

5'-GGCUGUCAUUCAGUACUCCUGGAUGGG-3'   (SEQ ID NO: 4681)
                  3'-CCGACAGUAAGUCAUGAGGACCUACCC-5'   (SEQ ID NO: 817)

AR-3346 Target:   5'-GGCTGTCATTCAGTACTCCTGGATGGG-3'    (SEQ ID NO: 847)

5'-CUGAAAAAUCAAAAAUUCUUUGAUGAA-3'   (SEQ ID NO: 4682)
                  3'-GACUUUUUAGUUUUUAAGAAACUACUU-5'   (SEQ ID NO: 818)

AR-3605 Target:   5'-CTGAAAAATCAAAAATTCTTTGATGAA-3'    (SEQ ID NO: 848)

5'-AAAAUUCUUUGAUGAACUUCGAAUGAA-3'   (SEQ ID NO: 4683)
                  3'-UUUUAAGAAACUACUUGAAGCUUACUU-5'   (SEQ ID NO: 819)

AR-3616 Target:   5'-AAAATTCTTTGATGAACTTCGAATGAA-3'    (SEQ ID NO: 849)

5'-UGCUAAUCAAGUCACACAUGGUGAGCG-3'   (SEQ ID NO: 4684)
                  3'-ACGAUUAGUUCAGUGUGUACCACUCGC-5'   (SEQ ID NO: 820)

AR-3783 Target:   5'-TGCTAATCAAGTCACACATGGTGAGCG-3'    (SEQ ID NO: 850)

5'-AGCGUGGACUUUCCGGAAAUGAUGGCA-3'   (SEQ ID NO: 4685)
                  3'-UCGCACCUGAAAGGCCUUUACUACCGU-5'   (SEQ ID NO: 821)

AR-3806 Target:   5'-AGCGTGGACTTTCCGGAAATGATGGCA-3'    (SEQ ID NO: 851)

5'-CCUUGGGGAAUUUCCUCUAUUGAUGUA-3'   (SEQ ID NO: 4686)
                  3'-GGAACCCCUUAAAGGAGAUAACUACAU-5'   (SEQ ID NO: 822)

AR-3995 Target:   5'-CCTTGGGGAATTTCCTCTATTGATGTA-3'    (SEQ ID NO: 852)

5'-UCUGUGUUUUGAAUGGUGUUGUAUGCC-3'   (SEQ ID NO: 4687)
                  3'-AGACACAAAACUUACCACAACAUACGG-5'   (SEQ ID NO: 823)

AR-4158 Target:   5'-TCTGTGTTTTGAATGGTGTTGTATGCC-3'    (SEQ ID NO: 853)

5'-GUUGUAUGCCUUUAAAUCUGUGAUGAU-3'   (SEQ ID NO: 4688)
                  3'-CAACAUACGGAAAUUUAGACACUACUA-5'   (SEQ ID NO: 824)

AR-4175 Target:   5'-GTTGTATGCCTTTAAATCTGTGATGAT-3'    (SEQ ID NO: 854)

5'-UUUAGAGAGCUAAGAUUAUCUGGGGAA-3'   (SEQ ID NO: 4689)
                  3'-AAAUCUCUCGAUUCUAAUAGACCCCUU-5'   (SEQ ID NO: 825)

AR-4292 Target:   5'-TTTAGAGAGCTAAGATTATCTGGGGAA-3'    (SEQ ID NO: 855)

5'-UCGGUGAAGUUUUUAAAAGCUGCUAAA-3'   (SEQ ID NO: 4690)
                  3'-AGCCACUUCAAAAAUUUUCGACGAUUU-5'   (SEQ ID NO: 970)

AR-248 Target:    5'-TCGGTGAAGTTTTTAAAAGCTGCTAAA-3'    (SEQ ID NO: 1024)

5'-AGUUUUUAAAAGCUGCUAAAGACUCGG-3'   (SEQ ID NO: 4691)
                  3'-UCAAAAAUUUUCGACGAUUUCUGAGCC-5'   (SEQ ID NO: 971)

AR-255 Target:    5'-AGTTTTTAAAAGCTGCTAAAGACTCGG-3'    (SEQ ID NO: 1025)

5'-GCAGAGAGGUAACUCCCUUUGGCUGCG-3'   (SEQ ID NO: 4692)
                  3'-CGUCUCUCCAUUGAGGGAAACCGACGC-5'   (SEQ ID NO: 972)

AR-489 Target:    5'-GCAGAGAGGTAACTCCCTTTGGCTGCG-3'    (SEQ ID NO: 1026)

5'-CAGAGAUCAAAAGAUGAAAAGGCAGUC-3'   (SEQ ID NO: 4693)
                  3'-GUCUCUAGUUUUCUACUUUUCCGUCAG-5'   (SEQ ID NO: 973)
```

TABLE 7-continued

Selected Human Anti-AR 27mer "Blunt/Blunt" DsiRNA Agents

```
AR-690  Target:   5'-CAGAGATCAAAAGATGAAAAGGCAGTC-3'    (SEQ ID NO: 1027)

5'-CAAAAAACAAAACAAACAAAAACAAAA-3'    (SEQ ID NO: 4694)
                  3'-GUUUUUUGUUUUGUUUGUUUUUGUUUU-5'    (SEQ ID NO: 974)

AR-731  Target:   5'-CAAAAAACAAAACAAACAAAAACAAAA-3'    (SEQ ID NO: 1028)

5'-AAAUAAAAGAAAAAGAUAAUAACUCAG-3'    (SEQ ID NO: 4695)
                  3'-UUUAUUUUCUUUUUCUAUUAUUGAGUC-5'    (SEQ ID NO: 975)

AR-764  Target:   5'-AAATAAAAGAAAAAGATAATAACTCAG-3'    (SEQ ID NO: 1029)

5'-AGAAAAAGAUAAUAACUCAGUUCUUAU-3'    (SEQ ID NO: 4696)
                  3'-UCUUUUUCUAUUAUUGAGUCAAGAAUA-5'    (SEQ ID NO: 976)

AR-771  Target:   5'-AGAAAAAGATAATAACTCAGTTCTTAT-3'    (SEQ ID NO: 1030)

5'-AUAAUAACUCAGUUCUUAUUUGCACCU-3'    (SEQ ID NO: 4697)
                  3'-UAUUAUUGAGUCAAGAAUAAACGUGGA-5'    (SEQ ID NO: 977)

AR-779  Target:   5'-ATAATAACTCAGTTCTTATTTGCACCT-3'    (SEQ ID NO: 1031)

5'-AGGUGGAGGAUUUUGUUUUUUUCUUUU-3'    (SEQ ID NO: 4698)
                  3'-UCCACCUCCUAAAACAAAAAAAGAAAA-5'    (SEQ ID NO: 978)

AR-830  Target:   5'-AGGTGGAGGATTTTGTTTTTTTCTTTT-3'    (SEQ ID NO: 1032)

5'-UUUUGUUUUUUUCUUUUAAGAUCUGGG-3'    (SEQ ID NO: 4699)
                  3'-AAAACAAAAAAAGAAAAUUCUAGACCC-5'    (SEQ ID NO: 979)

AR-840  Target:   5'-TTTTGTTTTTTTCTTTTAAGATCTGGG-3'    (SEQ ID NO: 1033)

5'-UUUUUUUCUUUUAAGAUCUGGGCAUCU-3'    (SEQ ID NO: 4700)
                  3'-AAAAAAAGAAAAUUCUAGACCCGUAGA-5'    (SEQ ID NO: 980)

AR-845  Target:   5'-TTTTTTTCTTTTAAGATCTGGGCATCT-3'    (SEQ ID NO: 1034)

5'-AUCUGGGCAUCUUUUGAAUCUACCCUU-3'    (SEQ ID NO: 4701)
                  3'-UAGACCCGUAGAAAACUUAGAUGGGAA-5'    (SEQ ID NO: 981)

AR-860  Target:   5'-ATCTGGGCATCTTTTGAATCTACCCTT-3'    (SEQ ID NO: 1035)

5'-UAAGGGAAGUAGGUGGAAGAUUCAGCC-3'    (SEQ ID NO: 4702)
                  3'-AUUCCCUUCAUCCACCUUCUAAGUCGG-5'    (SEQ ID NO: 982)

AR-1105 Target:   5'-TAAGGGAAGTAGGTGGAAGATTCAGCC-3'    (SEQ ID NO: 1036)

5'-GAGGAGCUUUCCAGAAUCUGUUCCAGA-3'    (SEQ ID NO: 4703)
                  3'-CUCCUCGAAAGGUCUUAGACAAGGUCU-5'    (SEQ ID NO: 983)

AR-1200 Target:   5'-GAGGAGCTTTCCAGAATCTGTTCCAGA-3'    (SEQ ID NO: 1037)

5'-AGCAGGAAGCAGUAUCCGAAGGCAGCA-3'    (SEQ ID NO: 4704)
                  3'-UCGUCCUUCGUCAUAGGCUUCCGUCGU-5'    (SEQ ID NO: 984)

AR-1734 Target:   5'-AGCAGGAAGCAGTATCCGAAGGCAGCA-3'    (SEQ ID NO: 1038)

5'-CCAAGGACAAUUACUUAGGGGGCACUU-3'    (SEQ ID NO: 4705)
                  3'-GGUUCCUGUUAAUGAAUCCCCCGUGAA-5'    (SEQ ID NO: 985)

AR-1803 Target:   5'-CCAAGGACAATTACTTAGGGGGCACTT-3'    (SEQ ID NO: 1039)

5'-AAGGAGUUGUGUAAGGCAGUGUCGGUG-3'    (SEQ ID NO: 4706)
                  3'-UUCCUCAACACAUUCCGUCACAGCCAC-5'    (SEQ ID NO: 986)

AR-1850 Target:   5'-AAGGAGTTGTGTAAGGCAGTGTCGGTG-3'    (SEQ ID NO: 1040)

5'-GGCAAGAGCACUGAAGAUACUGCUGAG-3'    (SEQ ID NO: 4707)
                  3'-CCGUUCUCGUGACUUCUAUGACGACUC-5'    (SEQ ID NO: 987)

AR-2039 Target:   5'-GGCAAGAGCACTGAAGATACTGCTGAG-3'    (SEQ ID NO: 1041)

5'-ACUGAAGAUACUGCUGAGUAUUCCCCU-3'    (SEQ ID NO: 4708)
                  3'-UGACUUCUAUGACGACUCAUAAGGGGA-5'    (SEQ ID NO: 988)
```

TABLE 7-continued

Selected Human Anti-AR 27mer "Blunt/Blunt" DsiRNA Agents

```
AR-2048 Target:  5'-ACTGAAGATACTGCTGAGTATTCCCCT-3'   (SEQ ID NO: 1042)

5'-CAAGGGAGGUUACACCAAAGGGCUAGA-3'   (SEQ ID NO: 4709)
                 3'-GUUCCCUCCAAUGUGGUUUCCCGAUCU-5'   (SEQ ID NO: 989)

AR-2077 Target:  5'-CAAGGGAGGTTACACCAAAGGGCTAGA-3'   (SEQ ID NO: 1043)

5'-CUUGUGUCAAAAGCGAAAUGGGCCCCU-3'   (SEQ ID NO: 4710)
                 3'-GAACACAGUUUUCGCUUUACCCGGGGA-5'   (SEQ ID NO: 990)

AR-2694 Target:  5'-CTTGTGTCAAAAGCGAAATGGGCCCCT-3'   (SEQ ID NO: 1044)

5'-AUGUUUUGCCCAUUGACUAUUACUUUC-3'   (SEQ ID NO: 4711)
                 3'-UACAAAACGGGUAACUGAUAAUGAAAG-5'   (SEQ ID NO: 991)

AR-2778 Target:  5'-ATGTTTTGCCCATTGACTATTACTTTC-3'   (SEQ ID NO: 1045)

5'-UGCAAGGUCUUCUUCAAAAGAGCCGCU-3'   (SEQ ID NO: 4712)
                 3'-ACGUUCCAGAAGAAGUUUUCUCGGCGA-5'   (SEQ ID NO: 992)

AR-2879 Target:  5'-TGCAAGGTCTTCTTCAAAAGAGCCGCT-3'   (SEQ ID NO: 1046)

5'-AAGGGAAACAGAAGUACCUGUGCGCCA-3'   (SEQ ID NO: 4713)
                 3'-UUCCCUUUGUCUUCAUGGACACGCGGU-5'   (SEQ ID NO: 993)

AR-2907 Target:  5'-AAGGGAAACAGAAGTACCTGTGCGCCA-3'   (SEQ ID NO: 1047)

5'-AUGAUUGCACUAUUGAUAAAUUCCGAA-3'   (SEQ ID NO: 4714)
                 3'-UACUAACGUGAUAACUAUUUAAGGCUU-5'   (SEQ ID NO: 994)

AR-2940 Target:  5'-ATGATTGCACTATTGATAAATTCCGAA-3'   (SEQ ID NO: 1048)

5'-UAAAUUCCGAAGGAAAAAUUGUCCAUC-3'   (SEQ ID NO: 4715)
                 3'-AUUUAAGGCUUCCUUUUUAACAGGUAG-5'   (SEQ ID NO: 995)

AR-2956 Target:  5'-TAAATTCCGAAGGAAAAATTGTCCATC-3'   (SEQ ID NO: 1049)

5'-AAGGAAAAAUUGUCCAUCUUGUCGUCU-3'   (SEQ ID NO: 4716)
                 3'-UUCCUUUUUAACAGGUAGAACAGCAGA-5'   (SEQ ID NO: 996)

AR-2965 Target:  5'-AAGGAAAAATTGTCCATCTTGTCGTCT-3'   (SEQ ID NO: 1050)

5'-GAAAAAUUGUCCAUCUUGUCGUCUUCG-3'   (SEQ ID NO: 4717)
                 3'-CUUUUUAACAGGUAGAACAGCAGAAGC-5'   (SEQ ID NO: 997)

AR-2968 Target:  5'-GAAAAATTGTCCATCTTGTCGTCTTCG-3'   (SEQ ID NO: 1051)

5'-GAAGAAACUUGGUAAUCUGAAACUACA-3'   (SEQ ID NO: 4718)
                 3'-CUUCUUUGAACCAUUAGACUUUGAUGU-5'   (SEQ ID NO: 998)

AR-3037 Target:  5'-GAAGAAACTTGGTAATCTGAAACTACA-3'   (SEQ ID NO: 1052)

5'-CAUUGAAGGCUAUGAAUGUCAGCCCAU-3'   (SEQ ID NO: 4719)
                 3'-GUAACUUCCGAUACUUACAGUCGGGUA-5'   (SEQ ID NO: 999)

AR-3133 Target:  5'-CATTGAAGGCTATGAATGTCAGCCCAT-3'   (SEQ ID NO: 1053)

5'-CAGGAAUUCCUGUGCAUGAAAGCACUG-3'   (SEQ ID NO: 4720)
                 3'-GUCCUUAAGGACACGUACUUUCGUGAC-5'   (SEQ ID NO: 1000)

AR-3548 Target:  5'-CAGGAATTCCTGTGCATGAAAGCACTG-3'   (SEQ ID NO: 1054)

5'-UCAAAAAUUCUUUGAUGAACUUCGAAU-3'   (SEQ ID NO: 4721)
                 3'-AGUUUUUAAGAAACUACUUGAAGCUUA-5'   (SEQ ID NO: 1001)

AR-3613 Target:  5'-TCAAAATTCTTTGATGAACTTCGAAT-3'    (SEQ ID NO: 1055)

5'-UCUUUGAUGAACUUCGAAUGAACUACA-3'   (SEQ ID NO: 4722)
                 3'-AGAAACUACUUGAAGCUUACUUGAUGU-5'   (SEQ ID NO: 1002)

AR-3621 Target:  5'-TCTTTGATGAACTTCGAATGAACTACA-3'   (SEQ ID NO: 1056)

5'-UUGAUGAACUUCGAAUGAACUACAUCA-3'   (SEQ ID NO: 4723)
                 3'-AACUACUUGAAGCUUACUUGAUGUAGU-5'   (SEQ ID NO: 1003)
```

TABLE 7-continued

Selected Human Anti-AR 27mer "Blunt/Blunt" DsiRNA Agents

```
AR-3624 Target:  5'-TTGATGAACTTCGAATGAACTACATCA-3'   (SEQ ID NO: 1057)

5'-UCGAAUGAACUACAUCAAGGAACUCGA-3'   (SEQ ID NO: 4724)
                 3'-AGCUUACUUGAUGUAGUUCCUUGAGCU-5'   (SEQ ID NO: 1004)

AR-3634 Target:  5'-TCGAATGAACTACATCAAGGAACTCGA-3'   (SEQ ID NO: 1058)

5'-UGCAAAAGAAAAAAUCCCACAUCCUGC-3'   (SEQ ID NO: 4725)
                 3'-ACGUUUUCUUUUUUAGGGUGUAGGACG-5'   (SEQ ID NO: 1005)

AR-3674 Target:  5'-TGCAAAAGAAAAAATCCCACATCCTGC-3'   (SEQ ID NO: 1059)

5'-AAAGAAAAAAUCCCACAUCCUGCUCAA-3'   (SEQ ID NO: 4726)
                 3'-UUUCUUUUUUAGGGUGUAGGACGAGUU-5'   (SEQ ID NO: 1006)

AR-3678 Target:  5'-AAAGAAAAAATCCCACATCCTGCTCAA-3'   (SEQ ID NO: 1060)

5'-ACUUUUGACCUGCUAAUCAAGUCACAC-3'   (SEQ ID NO: 4727)
                 3'-UGAAAACUGGACGAUUAGUUCAGUGUG-5'   (SEQ ID NO: 1007)

AR-3773 Target:  5'-ACTTTTGACCTGCTAATCAAGTCACAC-3'   (SEQ ID NO: 1061)

5'-CCAAGAUCCUUUCUGGGAAAGUCAAGC-3'   (SEQ ID NO: 4728)
                 3'-GGUUCUAGGAAAGACCCUUUCAGUUCG-5'   (SEQ ID NO: 1008)

AR-3855 Target:  5'-CCAAGATCCTTTCTGGGAAAGTCAAGC-3'   (SEQ ID NO: 1062)

5'-GGAAAGUCAAGCCCAUCUAUUUCCACA-3'   (SEQ ID NO: 4729)
                 3'-CCUUUCAGUUCGGGUAGAUAAAGGUGU-5'   (SEQ ID NO: 1009)

AR-3870 Target:  5'-GGAAAGTCAAGCCCATCTATTTCCACA-3'   (SEQ ID NO: 1063)

5'-AGAUGUCUUCUGCCUGUUAUAACUCUG-3'   (SEQ ID NO: 4730)
                 3'-UCUACAGAAGACGGACAAUAUUGAGAC-5'   (SEQ ID NO: 1010)

AR-3950 Target:  5'-AGATGTCTTCTGCCTGTTATAACTCTG-3'   (SEQ ID NO: 1064)

5'-GGGAAUUUCCUCUAUUGAUGUACAGUC-3'   (SEQ ID NO: 4731)
                 3'-CCCUUAAAGGAGAUAACUACAUGUCAG-5'   (SEQ ID NO: 1011)

AR-4000 Target:  5'-GGGAATTTCCTCTATTGATGTACAGTC-3'   (SEQ ID NO: 1065)

5'-UUGAUGUACAGUCUGUCAUGAACAUGU-3'   (SEQ ID NO: 4732)
                 3'-AACUACAUGUCAGACAGUACUUGUACA-5'   (SEQ ID NO: 1012)

AR-4014 Target:  5'-TTGATGTACAGTCTGTCATGAACATGT-3'   (SEQ ID NO: 1066)

5'-UACAGUCUGUCAUGAACAUGUUCCUGA-3'   (SEQ ID NO: 4733)
                 3'-AUGUCAGACAGUACUUGUACAAGGACU-5'   (SEQ ID NO: 1013)

AR-4020 Target:  5'-TACAGTCTGTCATGAACATGTTCCTGA-3'   (SEQ ID NO: 1067)

5'-GUCAUGAACAUGUUCCUGAAUUCUAUU-3'   (SEQ ID NO: 4734)
                 3'-CAGUACUUGUACAAGGACUUAAGAUAA-5'   (SEQ ID NO: 1014)

AR-4028 Target:  5'-GTCATGAACATGTTCCTGAATTCTATT-3'   (SEQ ID NO: 1068)

5'-ACAUGUUCCUGAAUUCUAUUUGCUGGG-3'   (SEQ ID NO: 4735)
                 3'-UGUACAAGGACUUAAGAUAAACGACCC-5'   (SEQ ID NO: 1015)

AR-4035 Target:  5'-ACATGTTCCTGAATTCTATTTGCTGGG-3'   (SEQ ID NO: 1069)

5'-GCUGGGCUUUUUUUUCUCUUUCUCUC-3'    (SEQ ID NO: 4736)
                 3'-CGACCCGAAAAAAAAGAGAAAGAGAG-5'    (SEQ ID NO: 1016)

AR-4056 Target:  5'-GCTGGGCTTTTTTTTCTCTTTCTCTC-3'    (SEQ ID NO: 1070)

5'-UUUUUUUCUCUUUCUCUCCUUUCUUUU-3'   (SEQ ID NO: 4737)
                 3'-AAAAAAAGAGAAAGAGAGGAAAGAAAA-5'   (SEQ ID NO: 1017)

AR-4065 Target:  5'-TTTTTTTCTCTTTCTCTCCTTTCTTTT-3'   (SEQ ID NO: 1071)

5'-GUGUUUUGAAUGGUGUUGUAUGCCUUU-3'   (SEQ ID NO: 4738)
                 3'-CACAAAACUUACCACAACAUACGGAAA-5'   (SEQ ID NO: 1018)
```

TABLE 7-continued

Selected Human Anti-AR 27mer "Blunt/Blunt" DsiRNA Agents

```
AR-4161 Target:  5'-GTGTTTTGAATGGTGTTGTATGCCTTT-3'    (SEQ ID NO: 1072)

5'-AUGGUGUUGUAUGCCUUUAAAUCUGUG-3'   (SEQ ID NO: 4739)
                 3'-UACCACAACAUACGGAAAUUUAGACAC-5'   (SEQ ID NO: 1019)

AR-4170 Target:  5'-ATGGTGTTGTATGCCTTTAAATCTGTG-3'   (SEQ ID NO: 1073)

5'-GUCAAGUUGUGCUUGUUUACAGCACUA-3'   (SEQ ID NO: 4740)
                 3'-CAGUUCAACACGAACAAAUGUCGUGAU-5'   (SEQ ID NO: 1020)

AR-4218 Target:  5'-GTCAAGTTGTGCTTGTTTACAGCACTA-3'   (SEQ ID NO: 1074)

5'-AGCUAAGAUUAUCUGGGGAAAUCAAAA-3'   (SEQ ID NO: 4741)
                 3'-UCGAUUCUAAUAGACCCCUUUAGUUUU-5'   (SEQ ID NO: 1021)

AR-4299 Target:  5'-AGCTAAGATTATCTGGGGAAATCAAAA-3'   (SEQ ID NO: 1075)

5'-UCUGGGGAAAUCAAAACAAAAACAAGC-3'   (SEQ ID NO: 4742)
                 3'-AGACCCCUUUAGUUUUGUUUUUGUUCG-5'   (SEQ ID NO: 1022)

AR-4310 Target:  5'-TCTGGGGAAATCAAAACAAAAACAAGC-3'   (SEQ ID NO: 1076)

5'-GGGAAAUCAAAACAAAAACAAGCAAAC-3'   (SEQ ID NO: 4743)
                 3'-CCCUUUAGUUUUGUUUUUGUUCGUUUG-5'   (SEQ ID NO: 1023)

AR-4314 Target:  5'-GGGAAATCAAAACAAAAACAAGCAAAC-3'   (SEQ ID NO: 1077)

5'-CGGUGAAGUUUUUAAAAGCUGCUAAAG-3'   (SEQ ID NO: 4744)
                 3'-GCCACUUCAAAAAUUUUCGACGAUUUC-5'   (SEQ ID NO: 1249)

AR-249 Target:   5'-CGGTGAAGTTTTTAAAAGCTGCTAAAG-3'   (SEQ ID NO: 1312)

5'-GUUUUUAAAAGCUGCUAAAGACUCGGA-3'   (SEQ ID NO: 4745)
                 3'-CAAAAAUUUUCGACGAUUUCUGAGCCU-5'   (SEQ ID NO: 1250)

AR-256 Target:   5'-GTTTTTAAAAGCTGCTAAAGACTCGGA-3'   (SEQ ID NO: 1313)

5'-UUUUAAAAGCUGCUAAAGACUCGGAGG-3'   (SEQ ID NO: 4746)
                 3'-AAAAUUUUCGACGAUUUCUGAGCCUCC-5'   (SEQ ID NO: 1251)

AR-258 Target:   5'-TTTTAAAAGCTGCTAAAGACTCGGAGG-3'   (SEQ ID NO: 1314)

5'-GCGGAGAGAACCCUCUGUUUUCCCCCA-3'   (SEQ ID NO: 4747)
                 3'-CGCCUCUCUUGGGAGACAAAAGGGGGU-5'   (SEQ ID NO: 1252)

AR-618 Target:   5'-GCGGAGAGAACCCTCTGTTTTCCCCCA-3'   (SEQ ID NO: 1315)

5'-AGAGAUCAAAAGAUGAAAAGGCAGUCA-3'   (SEQ ID NO: 4748)
                 3'-UCUCUAGUUUUCUACUUUUCCGUCAGU-5'   (SEQ ID NO: 1253)

AR-691 Target:   5'-AGAGATCAAAAGATGAAAAGGCAGTCA-3'   (SEQ ID NO: 1316)

5'-AUCAAAAGAUGAAAAGGCAGUCAGGUC-3'   (SEQ ID NO: 4749)
                 3'-UAGUUUUCUACUUUUCCGUCAGUCCAG-5'   (SEQ ID NO: 1254)

AR-695 Target:   5'-ATCAAAAGATGAAAAGGCAGTCAGGTC-3'   (SEQ ID NO: 1317)

5'-UUCAGUAGCCAAAAAACAAAACAAACA-3'   (SEQ ID NO: 4750)
                 3'-AAGUCAUCGGUUUUUUGUUUUGUUUGU-5'   (SEQ ID NO: 1255)

AR-722 Target:   5'-TTCAGTAGCCAAAAAACAAAACAAACA-3'   (SEQ ID NO: 1318)

5'-AAAAAACAAAACAAACAAAAACAAAAA-3'   (SEQ ID NO: 4751)
                 3'-UUUUUUGUUUUGUUUGUUUUUGUUUUU-5'   (SEQ ID NO: 1256)

AR-732 Target:   5'-AAAAAACAAAACAAACAAAAACAAAAA-3'   (SEQ ID NO: 1319)

5'-AAUAAAAGAAAAGAUAAUAACUCAGU-3'    (SEQ ID NO: 4752)
                 3'-UUAUUUUCUUUUUCUAUUAUUGAGUCA-5'   (SEQ ID NO: 1257)

AR-765 Target:   5'-AATAAAAGAAAAGATAATAACTCAGT-3'    (SEQ ID NO: 1320)

5'-UAAAAGAAAAGAUAAUAACUCAGUUC-3'    (SEQ ID NO: 4753)
                 3'-AUUUUCUUUUUCUAUUAUUGAGUCAAG-5'   (SEQ ID NO: 1258)
```

TABLE 7-continued

Selected Human Anti-AR 27mer "Blunt/Blunt" DsiRNA Agents

```
AR-767 Target:    5'-TAAAAGAAAAAGATAATAACTCAGTTC-3'      (SEQ ID NO: 1321)

5'-GAAAAAGAUAAUAACUCAGUUCUUAUU-3'     (SEQ ID NO: 4754)
                  3'-CUUUUUCUAUUAUUGAGUCAAGAAUAA-5'     (SEQ ID NO: 1259)

AR-772 Target:    5'-GAAAAAGATAATAACTCAGTTCTTATT-3'      (SEQ ID NO: 1322)

5'-UAAUAACUCAGUUCUUAUUUGCACCUA-3'     (SEQ ID NO: 4755)
                  3'-AUUAUUGAGUCAAGAAUAAACGUGGAU-5'     (SEQ ID NO: 1260)

AR-780 Target:    5'-TAATAACTCAGTTCTTATTTGCACCTA-3'      (SEQ ID NO: 1323)

5'-CUCAGUUCUUAUUUGCACCUACUUCAG-3'     (SEQ ID NO: 4756)
                  3'-GAGUCAAGAAUAAACGUGGAUGAAGUC-5'     (SEQ ID NO: 1261)

AR-786 Target:    5'-CTCAGTTCTTATTTGCACCTACTTCAG-3'      (SEQ ID NO: 1324)

5'-GGUGGAGGAUUUUGUUUUUUCUUUUA-3'      (SEQ ID NO: 4757)
                  3'-CCACCUCCUAAAACAAAAAAGAAAAU-5'      (SEQ ID NO: 1262)

AR-831 Target:    5'-GGTGGAGGATTTTGTTTTTTCTTTTA-3'       (SEQ ID NO: 1325)

5'-UUUGUUUUUUCUUUUAAGAUCUGGGC-3'      (SEQ ID NO: 4758)
                  3'-AAACAAAAAAGAAAAUUCUAGACCCG-5'      (SEQ ID NO: 1263)

AR-841 Target:    5'-TTTGTTTTTTCTTTTAAGATCTGGGC-3'       (SEQ ID NO: 1326)

5'-UUUUUUCUUUUAAGAUCUGGGCAUCUU-3'     (SEQ ID NO: 4759)
                  3'-AAAAAAGAAAAUUCUAGACCCGUAGAA-5'     (SEQ ID NO: 1264)

AR-846 Target:    5'-TTTTTTCTTTTAAGATCTGGGCATCTT-3'      (SEQ ID NO: 1327)

5'-UCUGGGCAUCUUUUGAAUCUACCCUUC-3'     (SEQ ID NO: 4760)
                  3'-AGACCCGUAGAAAACUUAGAUGGGAAG-5'     (SEQ ID NO: 1265)

AR-861 Target:    5'-TCTGGGCATCTTTTGAATCTACCCTTC-3'      (SEQ ID NO: 1328)

5'-CGCAAGUUUCCUUCUCUGGAGCUUCCC-3'     (SEQ ID NO: 4761)
                  3'-GCGUUCAAAGGAAGAGACCUCGAAGGG-5'     (SEQ ID NO: 1266)

AR-997 Target:    5'-CGCAAGTTTCCTTCTCTGGAGCTTCCC-3'      (SEQ ID NO: 1329)

5'-AAGGGAAGUAGGUGGAAGAUUCAGCCA-3'     (SEQ ID NO: 4762)
                  3'-UUCCCUUCAUCCACCUUCUAAGUCGGU-5'     (SEQ ID NO: 1267)

AR-1106 Target:   5'-AAGGGAAGTAGGTGGAAGATTCAGCCA-3'      (SEQ ID NO: 1330)

5'-GGAAGUAGGUGGAAGAUUCAGCCAAGC-3'     (SEQ ID NO: 4763)
                  3'-CCUUCAUCCACCUUCUAAGUCGGUUCG-5'     (SEQ ID NO: 1268)

AR-1109 Target:   5'-GGAAGTAGGTGGAAGATTCAGCCAAGC-3'      (SEQ ID NO: 1331)

5'-CAAGGACAAUUACUUAGGGGGCACUUC-3'     (SEQ ID NO: 4764)
                  3'-GUUCCUGUUAAUGAAUCCCCCGUGAAG-5'     (SEQ ID NO: 1269)

AR-1804 Target:   5'-CAAGGACAATTACTTAGGGGGCACTTC-3'      (SEQ ID NO: 1332)

5'-GCCGAAUGCAAAGGUUCUCUGCUAGAC-3'     (SEQ ID NO: 4765)
                  3'-CGGCUUACGUUUCCAAGAGACGAUCUG-5'     (SEQ ID NO: 1270)

AR-2003 Target:   5'-GCCGAATGCAAAGGTTCTCTGCTAGAC-3'      (SEQ ID NO: 1333)

5'-GCAAGAGCACUGAAGAUACUGCUGAGU-3'     (SEQ ID NO: 4766)
                  3'-CGUUCUCGUGACUUCUAUGACGACUCA-5'     (SEQ ID NO: 1271)

AR-2040 Target:   5'-GCAAGAGCACTGAAGATACTGCTGAGT-3'      (SEQ ID NO: 1334)

5'-CUGAAGAUACUGCUGAGUAUUCCCUU-3'      (SEQ ID NO: 4767)
                  3'-GACUUCUAUGACGACUCAUAAGGGAA-5'      (SEQ ID NO: 1272)

AR-2049 Target:   5'-CTGAAGATACTGCTGAGTATTCCCTT-3'       (SEQ ID NO: 1335)

5'-UUGUGUCAAAAGCGAAAUGGGCCCCUG-3'     (SEQ ID NO: 4768)
                  3'-AACACAGUUUUCGCUUUACCCGGGGAC-5'     (SEQ ID NO: 1273)
```

TABLE 7-continued

Selected Human Anti-AR 27mer "Blunt/Blunt" DsiRNA Agents

```
AR-2695 Target:   5'-TTGTGTCAAAAGCGAAATGGGCCCCTG-3'   (SEQ ID NO: 1336)

5'-UGUUUUGCCCAUUGACUAUUACUUUCC-3'   (SEQ ID NO: 4769)
                  3'-ACAAAACGGGUAACUGAUAAUGAAAGG-5'   (SEQ ID NO: 1274)

AR-2779 Target:   5'-TGTTTTGCCCATTGACTATTACTTTCC-3'   (SEQ ID NO: 1337)

5'-CCCAUUGACUAUUACUUUCCACCCCAG-3'   (SEQ ID NO: 4770)
                  3'-GGGUAACUGAUAAUGAAAGGUGGGGUC-5'   (SEQ ID NO: 1275)

AR-2786 Target:   5'-CCCATTGACTATTACTTTCCACCCCAG-3'   (SEQ ID NO: 1338)

5'-GCAAGGUCUUCUUCAAAAGAGCCGCUG-3'   (SEQ ID NO: 4771)
                  3'-CGUUCCAGAAGAAGUUUUCUCGGCGAC-5'   (SEQ ID NO: 1276)

AR-2880 Target:   5'-GCAAGGTCTTCTTCAAAAGAGCCGCTG-3'   (SEQ ID NO: 1339)

5'-UGAUUGCACUAUUGAUAAAUUCCGAAG-3'   (SEQ ID NO: 4772)
                  3'-ACUAACGUGAUAACUAUUUAAGGCUUC-5'   (SEQ ID NO: 1277)

AR-2941 Target:   5'-TGATTGCACTATTGATAAATTCCGAAG-3'   (SEQ ID NO: 1340)

5'-UCCGAAGGAAAAAUUGUCCAUCUUGUC-3'   (SEQ ID NO: 4773)
                  3'-AGGCUUCCUUUUUAACAGGUAGAACAG-5'   (SEQ ID NO: 1278)

AR-2961 Target:   5'-TCCGAAGGAAAAATTGTCCATCTTGTC-3'   (SEQ ID NO: 1341)

5'-AGGAAAAAUUGUCCAUCUUGUCGUCUU-3'   (SEQ ID NO: 4774)
                  3'-UCCUUUUUAACAGGUAGAACAGCAGAA-5'   (SEQ ID NO: 1279)

AR-2966 Target:   5'-AGGAAAAATTGTCCATCTTGTCGTCTT-3'   (SEQ ID NO: 1342)

5'-GACAGUGUCACACAUUGAAGGCUAUGA-3'   (SEQ ID NO: 4775)
                  3'-CUGUCACAGUGUGUAACUUCCGAUACU-5'   (SEQ ID NO: 1280)

AR-3121 Target:   5'-GACAGTGTCACACATTGAAGGCTATGA-3'   (SEQ ID NO: 1343)

5'-AUUGAAGGCUAUGAAUGUCAGCCCAUC-3'   (SEQ ID NO: 4776)
                  3'-UAACUUCCGAUACUUACAGUCGGGUAG-5'   (SEQ ID NO: 1281)

AR-3134 Target:   5'-ATTGAAGGCTATGAATGTCAGCCCATC-3'   (SEQ ID NO: 1344)

5'-AGAUGGCUGUCAUUCAGUACUCCUGGA-3'   (SEQ ID NO: 4777)
                  3'-UCUACCGACAGUAAGUCAUGAGGACCU-5'   (SEQ ID NO: 1282)

AR-3342 Target:   5'-AGATGGCTGTCATTCAGTACTCCTGGA-3'   (SEQ ID NO: 1345)

5'-UCUGGUUUUCAAUGAGUACCGCAUGCA-3'   (SEQ ID NO: 4778)
                  3'-AGACCAAAAGUUACUCAUGGCGUACGU-5'   (SEQ ID NO: 1283)

AR-3445 Target:   5'-TCTGGTTTTCAATGAGTACCGCATGCA-3'   (SEQ ID NO: 1346)

5'-AGGAAUUCCUGUGCAUGAAAGCACUGC-3'   (SEQ ID NO: 4779)
                  3'-UCCUUAAGGACACGUACUUUCGUGACG-5'   (SEQ ID NO: 1284)

AR-3549 Target:   5'-AGGAATTCCTGTGCATGAAAGCACTGC-3'   (SEQ ID NO: 1347)

5'-CAAAAAUUCUUUGAUGAACUUCGAAUG-3'   (SEQ ID NO: 4780)
                  3'-GUUUUUAAGAAACUACUUGAAGCUUAC-5'   (SEQ ID NO: 1285)

AR-3614 Target:   5'-CAAAAATTCTTTGATGAACTTCGAATG-3'   (SEQ ID NO: 1348)

5'-CUUUGAUGAACUUCGAAUGAACUACAU-3'   (SEQ ID NO: 4781)
                  3'-GAAACUACUUGAAGCUUACUUGAUGUA-5'   (SEQ ID NO: 1286)

AR-3622 Target:   5'-CTTTGATGAACTTCGAATGAACTACAT-3'   (SEQ ID NO: 1349)

5'-UGAUGAACUUCGAAUGAACUACAUCAA-3'   (SEQ ID NO: 4782)
                  3'-ACUACUUGAAGCUUACUUGAUGUAGUU-5'   (SEQ ID NO: 1287)

AR-3625 Target:   5'-TGATGAACTTCGAATGAACTACATCAA-3'   (SEQ ID NO: 1350)

5'-CGAAUGAACUACAUCAAGGAACUCGAU-3'   (SEQ ID NO: 4783)
                  3'-GCUUACUUGAUGUAGUUCCUUGAGCUA-5'   (SEQ ID NO: 1288)
```

TABLE 7-continued

Selected Human Anti-AR 27mer "Blunt/Blunt" DsiRNA Agents

```
AR-3635  Target:  5'-CGAATGAACTACATCAAGGAACTCGAT-3'   (SEQ ID NO: 1351)

5'-AAUGAACUACAUCAAGGAACUCGAUCG-3'   (SEQ ID NO: 4784)
                  3'-UUACUUGAUGUAGUUCCUUGAGCUAGC-5'   (SEQ ID NO: 1289)

AR-3637  Target:  5'-AATGAACTACATCAAGGAACTCGATCG-3'   (SEQ ID NO: 1352)

5'-GCAAAAGAAAAAAUCCCACAUCCUGCU-3'   (SEQ ID NO: 4785)
                  3'-CGUUUUCUUUUUUAGGGUGUAGGACGA-5'   (SEQ ID NO: 1290)

AR-3675  Target:  5'-GCAAAAGAAAAAATCCCACATCCTGCT-3'   (SEQ ID NO: 1353)

5'-AAGAAAAAAUCCCACAUCCUGCUCAAG-3'   (SEQ ID NO: 4786)
                  3'-UUCUUUUUUAGGGUGUAGGACGAGUUC-5'   (SEQ ID NO: 1291)

AR-3679  Target:  5'-AAGAAAAAATCCCACATCCTGCTCAAG-3'   (SEQ ID NO: 1354)

5'-CUUUUGACCUGCUAAUCAAGUCACACA-3'   (SEQ ID NO: 4787)
                  3'-GAAAACUGGACGAUUAGUUCAGUGUGU-5'   (SEQ ID NO: 1292)

AR-3774  Target:  5'-CTTTTGACCTGCTAATCAAGTCACACA-3'   (SEQ ID NO: 1355)

5'-GCCUGUUAUAACUCUGCACUACUCCUC-3'   (SEQ ID NO: 4788)
                  3'-CGGACAAUAUUGAGACGUGAUGAGGAG-5'   (SEQ ID NO: 1293)

AR-3961  Target:  5'-GCCTGTTATAACTCTGCACTACTCCTC-3'   (SEQ ID NO: 1356)

5'-CUGUUAUAACUCUGCACUACUCCUCUG-3'   (SEQ ID NO: 4789)
                  3'-GACAAUAUUGAGACGUGAUGAGGAGAC-5'   (SEQ ID NO: 1294)

AR-3963  Target:  5'-CTGTTATAACTCTGCACTACTCCTCTG-3'   (SEQ ID NO: 1357)

5'-GGAAUUUCCUCUAUUGAUGUACAGUCU-3'   (SEQ ID NO: 4790)
                  3'-CCUUAAAGGAGAUAACUACAUGUCAGA-5'   (SEQ ID NO: 1295)

AR-4001  Target:  5'-GGAATTTCCTCTATTGATGTACAGTCT-3'   (SEQ ID NO: 1358)

5'-CUCUAUUGAUGUACAGUCUGUCAUGAA-3'   (SEQ ID NO: 4791)
                  3'-GAGAUAACUACAUGUCAGACAGUACUU-5'   (SEQ ID NO: 1296)

AR-4009  Target:  5'-CTCTATTGATGTACAGTCTGTCATGAA-3'   (SEQ ID NO: 1359)

5'-UCAUGAACAUGUUCCUGAAUUCUAUUU-3'   (SEQ ID NO: 4792)
                  3'-AGUACUUGUACAAGGACUUAAGAUAAA-5'   (SEQ ID NO: 1297)

AR-4029  Target:  5'-TCATGAACATGTTCCTGAATTCTATTT-3'   (SEQ ID NO: 1360)

5'-UCCUGAAUUCUAUUUGCUGGGCUUUUU-3'   (SEQ ID NO: 4793)
                  3'-AGGACUUAAGAUAAACGACCCGAAAAA-5'   (SEQ ID NO: 1298)

AR-4041  Target:  5'-TCCTGAATTCTATTTGCTGGGCTTTTT-3'   (SEQ ID NO: 1361)

5'-GCUUUUUUUUCUCUUUCUCUCCUUUC-3'    (SEQ ID NO: 4794)
                  3'-CGAAAAAAAAGAGAAAGAGAGGAAAG-5'    (SEQ ID NO: 1299)

AR-4061  Target:  5'-GCTTTTTTTTCTCTTTCTCTCCTTTC-3'    (SEQ ID NO: 1362)

5'-UUUUUUCUCUUUCUCUCCUUUCUUUUU-3'   (SEQ ID NO: 4795)
                  3'-AAAAAAGAGAAAGAGAGGAAAGAAAAA-5'   (SEQ ID NO: 1300)

AR-4066  Target:  5'-TTTTTTCTCTTTCTCTCCTTTCTTTTT-3'   (SEQ ID NO: 1363)

5'-CUCUUUCUCUCCUUUCUUUUUCUUCUU-3'   (SEQ ID NO: 4796)
                  3'-GAGAAAGAGAGGAAAGAAAAAGAAGAA-5'   (SEQ ID NO: 1301)

AR-4072  Target:  5'-CTCTTTCTCTCCTTTCTTTTTCTTCTT-3'   (SEQ ID NO: 1364)

5'-CCAUGGCACCUUCAGACUUUGCUUCCC-3'   (SEQ ID NO: 4797)
                  3'-GGUACCGUGGAAGUCUGAAACGAAGGG-5'   (SEQ ID NO: 1302)

AR-4118  Target:  5'-CCATGGCACCTTCAGACTTTGCTTCCC-3'   (SEQ ID NO: 1365)

5'-UGUUUUGAAUGGUGUUGUAUGCCUUUA-3'   (SEQ ID NO: 4798)
                  3'-ACAAAACUUACCACAACAUACGGAAAU-5'   (SEQ ID NO: 1303)
```

TABLE 7-continued

Selected Human Anti-AR 27mer "Blunt/Blunt" DsiRNA Agents

```
AR-4162 Target:  5'-TGTTTTGAATGGTGTTGTATGCCTTTA-3'      (SEQ ID NO: 1366)

5'-UGGUGUUGUAUGCCUUUAAAUCUGUGA-3'     (SEQ ID NO: 4799)
                 3'-ACCACAACAUACGGAAAUUUAGACACU-5'     (SEQ ID NO: 1304)

AR-4171 Target:  5'-TGGTGTTGTATGCCTTTAAATCTGTGA-3'      (SEQ ID NO: 1367)

5'-CUUUAAAUCUGUGAUGAUCCUCAUAUG-3'     (SEQ ID NO: 4800)
                 3'-GAAAUUUAGACACUACUAGGAGUAUAC-5'     (SEQ ID NO: 1305)

AR-4184 Target:  5'-CTTTAAATCTGTGATGATCCTCATATG-3'      (SEQ ID NO: 1368)

5'-UCUGUGAUGAUCCUCAUAUGGCCCAGU-3'     (SEQ ID NO: 4801)
                 3'-AGACACUACUAGGAGUAUACCGGGUCA-5'     (SEQ ID NO: 1306)

AR-4191 Target:  5'-TCTGTGATGATCCTCATATGGCCCAGT-3'      (SEQ ID NO: 1369)

5'-AAGUUGUGCUUGUUUACAGCACUACUC-3'     (SEQ ID NO: 4802)
                 3'-UUCAACACGAACAAAUGUCGUGAUGAG-5'     (SEQ ID NO: 1307)

AR-4221 Target:  5'-AAGTTGTGCTTGTTTACAGCACTACTC-3'      (SEQ ID NO: 1370)

5'-ACGUUUACUUAUCUUAUGCCACGGGAA-3'     (SEQ ID NO: 4803)
                 3'-UGCAAAUGAAUAGAAUACGGUGCCCUU-5'     (SEQ ID NO: 1308)

AR-4264 Target:  5'-ACGTTTACTTATCTTATGCCACGGGAA-3'      (SEQ ID NO: 1371)

5'-AGUUUAGAGAGCUAAGAUUAUCUGGGG-3'     (SEQ ID NO: 4804)
                 3'-UCAAAUCUCUCGAUUCUAAUAGACCCC-5'     (SEQ ID NO: 1309)

AR-4290 Target:  5'-AGTTTAGAGAGCTAAGATTATCTGGGG-3'      (SEQ ID NO: 1372)

5'-GCUAAGAUUAUCUGGGGAAAUCAAAAC-3'     (SEQ ID NO: 4805)
                 3'-CGAUUCUAAUAGACCCCUUUAGUUUUG-5'     (SEQ ID NO: 1310)

AR-4300 Target:  5'-GCTAAGATTATCTGGGGAAATCAAAAC-3'      (SEQ ID NO: 1373)

5'-CUGGGGAAAUCAAAACAAAAACAAGCA-3'     (SEQ ID NO: 4806)
                 3'-GACCCCUUUAGUUUUGUUUUUGUUCGU-5'     (SEQ ID NO: 1311)

AR-4311 Target:  5'-CTGGGGAAATCAAAACAAAAACAAGCA-3'      (SEQ ID NO: 1374)

5'-GAGCCAGCUUGCUGGGAGAGCGGGACG-3'     (SEQ ID NO: 4807)
                 3'-CUCGGUCGAACGACCCUCUCGCCCUGC-5'     (SEQ ID NO: 1906)

AR-39 Target:    5'-GAGCCAGCTTGCTGGGAGAGCGGGACG-3'      (SEQ ID NO: 2311)

5'-CGGCUCCAGCGACAGCCAACGCCUCUU-3'     (SEQ ID NO: 4808)
                 3'-GCCGAGGUCGCUGUCGGUUGCGGAGAA-5'     (SEQ ID NO: 1907)

AR-174 Target:   5'-CGGCTCCAGCGACAGCCAACGCCTCTT-3'      (SEQ ID NO: 2312)

5'-CAGCCAACGCCUCUUGCAGCGCGGCGG-3'     (SEQ ID NO: 4809)
                 3'-GUCGGUUGCGGAGAACGUCGCGCCGCC-5'     (SEQ ID NO: 1908)

AR-186 Target:   5'-CAGCCAACGCCTCTTGCAGCGCGGCGG-3'      (SEQ ID NO: 2313)

5'-GCCUCUUGCAGCGCGGCGGCUUCGAAG-3'     (SEQ ID NO: 4810)
                 3'-CGGAGAACGUCGCGCCGCCGAAGCUUC-5'     (SEQ ID NO: 1909)

AR-194 Target:   5'-GCCTCTTGCAGCGCGGCGGCTTCGAAG-3'      (SEQ ID NO: 2314)

5'-UGCAGCGCGGCGGCUUCGAAGCCGCCG-3'     (SEQ ID NO: 4811)
                 3'-ACGUCGCGCCGCCGAAGCUUCGGCGGC-5'     (SEQ ID NO: 1910)

AR-200 Target:   5'-TGCAGCGCGGCGGCTTCGAAGCCGCCG-3'      (SEQ ID NO: 2315)

5'-CGAAGCCGCCGCCCGGAGCUGCCCUUU-3'     (SEQ ID NO: 4812)
                 3'-GCUUCGGCGGCGGGCCUCGACGGGAAA-5'     (SEQ ID NO: 1911)

AR-216 Target:   5'-CGAAGCCGCCGCCCGGAGCTGCCCTTT-3'      (SEQ ID NO: 2316)

5'-CGCCGCCCGGAGCUGCCCUUUCCUCUU-3'     (SEQ ID NO: 4813)
                 3'-GCGGCGGGCCUCGACGGGAAAGGAGAA-5'     (SEQ ID NO: 1912)
```

TABLE 7-continued

Selected Human Anti-AR 27mer "Blunt/Blunt" DsiRNA Agents

```
AR-222 Target:    5'-CGCCGCCCGGAGCTGCCCTTTCCTCTT-3'   (SEQ ID NO: 2317)

5'-UGAAGUUUUUAAAAGCUGCUAAAGACU-3'   (SEQ ID NO: 4814)
                  3'-ACUUCAAAAAUUUUCGACGAUUUCUGA-5'   (SEQ ID NO: 1913)

AR-252 Target:    5'-TGAAGTTTTTAAAAGCTGCTAAAGACT-3'   (SEQ ID NO: 2318)

5'-CCGUCUUCUCUCCCGCAGCUGCCUCAG-3'   (SEQ ID NO: 4815)
                  3'-GGCAGAAGAGAGGGCGUCGACGGAGUC-5'   (SEQ ID NO: 1914)

AR-375 Target:    5'-CCGTCTTCTCTCCCGCAGCTGCCTCAG-3'   (SEQ ID NO: 2319)

5'-CCGCAGCUGCCUCAGUCGGCUACUCUC-3'   (SEQ ID NO: 4816)
                  3'-GGCGUCGACGGAGUCAGCCGAUGAGAG-5'   (SEQ ID NO: 1915)

AR-387 Target:    5'-CCGCAGCTGCCTCAGTCGGCTACTCTC-3'   (SEQ ID NO: 2320)

5'-UUUGGCUGCGAGCGGGCGAGCUAGCUG-3'   (SEQ ID NO: 4817)
                  3'-AAACCGACGCUCGCCCGCUCGAUCGAC-5'   (SEQ ID NO: 1916)

AR-506 Target:    5'-TTTGGCTGCGAGCGGGCGAGCTAGCTG-3'   (SEQ ID NO: 2321)

5'-CGGGCGAGCUAGCUGCACAUUGCAAAG-3'   (SEQ ID NO: 4818)
                  3'-GCCCGCUCGAUCGACGUGUAACGUUUC-5'   (SEQ ID NO: 1917)

AR-518 Target:    5'-CGGGCGAGCTAGCTGCACATTGCAAAG-3'   (SEQ ID NO: 2322)

5'-UCUCUCUCCACCUCCUCCUGCCUUCCC-3'   (SEQ ID NO: 4819)
                  3'-AGAGAGAGGUGGAGGAGGACGGAAGGG-5'   (SEQ ID NO: 1918)

AR-646 Target:    5'-TCTCTCTCCACCTCCTCCTGCCTTCCC-3'   (SEQ ID NO: 2323)

5'-CCAGAGAUCAAAAGAUGAAAAGGCAGU-3'   (SEQ ID NO: 4820)
                  3'-GGUCUCUAGUUUUCUACUUUUCCGUCA-5'   (SEQ ID NO: 1919)

AR-689 Target:    5'-CCAGAGATCAAAAGATGAAAAGGCAGT-3'   (SEQ ID NO: 2324)

5'-CAGUAGCCAAAAAACAAACAAACAAA-3'    (SEQ ID NO: 4821)
                  3'-GUCAUCGGUUUUUUGUUUGUUUGUUU-5'    (SEQ ID NO: 1920)

AR-724 Target:    5'-CAGTAGCCAAAAAACAAACAAACAAA-3'    (SEQ ID NO: 2325)

5'-CCAAAAAACAAACAAACAAAAACAAA-3'    (SEQ ID NO: 4822)
                  3'-GGUUUUUUGUUUGUUUGUUUUUGUUU-5'    (SEQ ID NO: 1921)

AR-730 Target:    5'-CCAAAAAACAAACAAACAAAAACAAA-3'    (SEQ ID NO: 2326)

5'-ACAAAACAAACAAAAACAAAAAAGCCG-3'   (SEQ ID NO: 4823)
                  3'-UGUUUUGUUUGUUUUUGUUUUUUCGGC-5'   (SEQ ID NO: 1922)

AR-737 Target:    5'-ACAAAACAAACAAAAACAAAAAAGCCG-3'   (SEQ ID NO: 2327)

5'-ACAAAAAAGCCGAAAUAAAAGAAAAAG-3'   (SEQ ID NO: 4824)
                  3'-UGUUUUUUCGGCUUUAUUUUCUUUUUC-5'   (SEQ ID NO: 1923)

AR-752 Target:    5'-ACAAAAAAGCCGAAATAAAAGAAAAAG-3'   (SEQ ID NO: 2328)

5'-GCCGAAAUAAAAGAAAAAGAUAAUAAC-3'   (SEQ ID NO: 4825)
                  3'-CGGCUUUAUUUUCUUUUUCUAUUAUUG-5'   (SEQ ID NO: 1924)

AR-760 Target:    5'-GCCGAAATAAAAGAAAAAGATAATAAC-3'   (SEQ ID NO: 2329)

5'-AAGAAAAAGAUAAUAACUCAGUUCUUA-3'   (SEQ ID NO: 4826)
                  3'-UUCUUUUUCUAUUAUUGAGUCAAGAAU-5'   (SEQ ID NO: 1925)

AR-770 Target:    5'-AAGAAAAAGATAATAACTCAGTTCTTA-3'   (SEQ ID NO: 2330)

5'-AAAGAUAAUAACUCAGUUCUUAUUUGC-3'   (SEQ ID NO: 4827)
                  3'-UUUCUAUUAUUGAGUCAAGAAUAAACG-5'   (SEQ ID NO: 1926)

AR-775 Target:    5'-AAAGATAATAACTCAGTTCTTATTTGC-3'   (SEQ ID NO: 2331)

5'-GAUAAUAACUCAGUUCUUAUUUGCACC-3'   (SEQ ID NO: 4828)
                  3'-CUAUUAUUGAGUCAAGAAUAAACGUGG-5'   (SEQ ID NO: 1927)
```

TABLE 7-continued

Selected Human Anti-AR 27mer "Blunt/Blunt" DsiRNA Agents

```
AR-778 Target:    5'-GATAATAACTCAGTTCTTATTTGCACC-3'   (SEQ ID NO: 2332)

5'-UGGAGGAUUUGUUUUUUCUUUUAAG-3'    (SEQ ID NO: 4829)
                  3'-ACCUCCUAAAACAAAAAAGAAAAUUC-5'   (SEQ ID NO: 1928)

AR-833 Target:    5'-TGGAGGATTTTGTTTTTTCTTTTAAG-3'   (SEQ ID NO: 2333)

5'-GAUUUUGUUUUUUCUUUUAAGAUCUG-3'   (SEQ ID NO: 4830)
                  3'-CUAAAACAAAAAAGAAAAUUCUAGAC-5'   (SEQ ID NO: 1929)

AR-838 Target:    5'-GATTTTGTTTTTTCTTTTAAGATCTG-3'   (SEQ ID NO: 2334)

5'-GUUUUUUCUUUUAAGAUCUGGGCAUC-3'   (SEQ ID NO: 4831)
                  3'-CAAAAAAGAAAAUUCUAGACCCGUAG-5'   (SEQ ID NO: 1930)

AR-844 Target:    5'-GTTTTTTTCTTTTAAGATCTGGGCATC-3'  (SEQ ID NO: 2335)

5'-GGGCAUCUUUUGAAUCUACCCUUCAAG-3'  (SEQ ID NO: 4832)
                  3'-CCCGUAGAAAACUUAGAUGGGAAGUUC-5'  (SEQ ID NO: 1931)

AR-864 Target:    5'-GGGCATCTTTTGAATCTACCCTTCAAG-3'  (SEQ ID NO: 2336)

5'-CAGAGCGCUUUUUGCGUGGUUGCUCCC-3'  (SEQ ID NO: 4833)
                  3'-GUCUCGCGAAAAACGCACCAACGAGGG-5'  (SEQ ID NO: 1932)

AR-971 Target:    5'-CAGAGCGCTTTTTGCGTGGTTGCTCCC-3'  (SEQ ID NO: 2337)

5'-CGCUUUUUGCGUGGUUGCUCCCGCAAG-3'  (SEQ ID NO: 4834)
                  3'-GCGAAAAACGCACCAACGAGGGCGUUC-5'  (SEQ ID NO: 1933)

AR-976 Target:    5'-CGCTTTTTGCGTGGTTGCTCCCGCAAG-3'  (SEQ ID NO: 2338)

5'-AAGUUUCCUUCUCUGGAGCUUCCCGCA-3'  (SEQ ID NO: 4835)
                  3'-UUCAAAGGAAGAGACCUCGAAGGGCGU-5'  (SEQ ID NO: 1934)

AR-1000 Target:   5'-AAGTTTCCTTCTCTGGAGCTTCCCGCA-3'  (SEQ ID NO: 2339)

5'-AGCUUCCCGCAGGUGGGCAGCUAGCUG-3'  (SEQ ID NO: 4836)
                  3'-UCGAAGGGCGUCCACCCGUCGAUCGAC-5'  (SEQ ID NO: 1935)

AR-1016 Target:   5'-AGCTTCCCGCAGGTGGGCAGCTAGCTG-3'  (SEQ ID NO: 2340)

5'-GUGGGCAGCUAGCUGCAGCGACUACCG-3'  (SEQ ID NO: 4837)
                  3'-CACCCGUCGAUCGACGUCGCUGAUGGC-5'  (SEQ ID NO: 1936)

AR-1028 Target:   5'-GTGGGCAGCTAGCTGCAGCGACTACCG-3'  (SEQ ID NO: 2341)

5'-AAGUGCAGUUAGGGCUGGGAAGGGUCU-3'  (SEQ ID NO: 4838)
                  3'-UUCACGUCAAUCCCGACCCUUCCCAGA-5'  (SEQ ID NO: 1937)

AR-1146 Target:   5'-AAGTGCAGTTAGGGCTGGGAAGGGTCT-3'  (SEQ ID NO: 2342)

5'-AGUGCAGUUAGGGCUGGGAAGGGUCUA-3'  (SEQ ID NO: 4839)
                  3'-UCACGUCAAUCCCGACCCUUCCCAGAU-5'  (SEQ ID NO: 1938)

AR-1147 Target:   5'-AGTGCAGTTAGGGCTGGGAAGGGTCTA-3'  (SEQ ID NO: 2343)

5'-GUGCAGUUAGGGCUGGGAAGGGUCUAC-3'  (SEQ ID NO: 4840)
                  3'-CACGUCAAUCCCGACCCUUCCCAGAUG-5'  (SEQ ID NO: 1939)

AR-1148 Target:   5'-GTGCAGTTAGGGCTGGGAAGGGTCTAC-3'  (SEQ ID NO: 2344)

5'-UGCAGUUAGGGCUGGGAAGGGUCUACC-3'  (SEQ ID NO: 4841)
                  3'-ACGUCAAUCCCGACCCUUCCCAGAUGG-5'  (SEQ ID NO: 1940)

AR-1149 Target:   5'-TGCAGTTAGGGCTGGGAAGGGTCTACC-3'  (SEQ ID NO: 2345)

5'-GCAGUUAGGGCUGGGAAGGGUCUACCC-3'  (SEQ ID NO: 4842)
                  3'-CGUCAAUCCCGACCCUUCCCAGAUGGG-5'  (SEQ ID NO: 1941)

AR-1150 Target:   5'-GCAGTTAGGGCTGGGAAGGGTCTACCC-3'  (SEQ ID NO: 2346)

5'-CAGUUAGGGCUGGGAAGGGUCUACCCU-3'  (SEQ ID NO: 4843)
                  3'-GUCAAUCCCGACCCUUCCCAGAUGGGA-5'  (SEQ ID NO: 1942)
```

TABLE 7-continued

Selected Human Anti-AR 27mer "Blunt/Blunt" DsiRNA Agents

```
AR-1151 Target:  5'-CAGTTAGGGCTGGGAAGGGTCTACCCT-3'    (SEQ ID NO: 2347)

5'-AGUUAGGGCUGGGAAGGGUCUACCCUC-3'    (SEQ ID NO: 4844)
                 3'-UCAAUCCCGACCCUUCCCAGAUGGGAG-5'    (SEQ ID NO: 1943)

AR-1152 Target:  5'-AGTTAGGGCTGGGAAGGGTCTACCCTC-3'    (SEQ ID NO: 2348)

5'-GUUAGGGCUGGGAAGGGUCUACCCUCG-3'    (SEQ ID NO: 4845)
                 3'-CAAUCCCGACCCUUCCCAGAUGGGAGC-5'    (SEQ ID NO: 1944)

AR-1153 Target:  5'-GTTAGGGCTGGGAAGGGTCTACCCTCG-3'    (SEQ ID NO: 2349)

5'-UUAGGGCUGGGAAGGGUCUACCCUCGG-3'    (SEQ ID NO: 4846)
                 3'-AAUCCCGACCCUUCCCAGAUGGGAGCC-5'    (SEQ ID NO: 1945)

AR-1154 Target:  5'-TTAGGGCTGGGAAGGGTCTACCCTCGG-3'    (SEQ ID NO: 2350)

5'-UAGGGCUGGGAAGGGUCUACCCUCGGC-3'    (SEQ ID NO: 4847)
                 3'-AUCCCGACCCUUCCCAGAUGGGAGCCG-5'    (SEQ ID NO: 1946)

AR-1155 Target:  5'-TAGGGCTGGGAAGGGTCTACCCTCGGC-3'    (SEQ ID NO: 2351)

5'-AGGGCUGGGAAGGGUCUACCCUCGGCC-3'    (SEQ ID NO: 4848)
                 3'-UCCCGACCCUUCCCAGAUGGGAGCCGG-5'    (SEQ ID NO: 1947)

AR-1156 Target:  5'-AGGGCTGGGAAGGGTCTACCCTCGGCC-3'    (SEQ ID NO: 2352)

5'-CUUUCCAGAAUCUGUUCCAGAGCGUGC-3'    (SEQ ID NO: 4849)
                 3'-GAAAGGUCUUAGACAAGGUCUCGCACG-5'    (SEQ ID NO: 1948)

AR-1206 Target:  5'-CTTTCCAGAATCTGTTCCAGAGCGTGC-3'    (SEQ ID NO: 2353)

5'-UUUCCAGAAUCUGUUCCAGAGCGUGCG-3'    (SEQ ID NO: 4850)
                 3'-AAAGGUCUUAGACAAGGUCUCGCACGC-5'    (SEQ ID NO: 1949)

AR-1207 Target:  5'-TTTCCAGAATCTGTTCCAGAGCGTGCG-3'    (SEQ ID NO: 2354)

5'-UUCCAGAAUCUGUUCCAGAGCGUGCGC-3'    (SEQ ID NO: 4851)
                 3'-AAGGUCUUAGACAAGGUCUCGCACGCG-5'    (SEQ ID NO: 1950)

AR-1208 Target:  5'-TTCCAGAATCTGTTCCAGAGCGTGCGC-3'    (SEQ ID NO: 2355)

5'-UCCAGAAUCUGUUCCAGAGCGUGCGCG-3'    (SEQ ID NO: 4852)
                 3'-AGGUCUUAGACAAGGUCUCGCACGCGC-5'    (SEQ ID NO: 1951)

AR-1209 Target:  5'-TCCAGAATCTGTTCCAGAGCGTGCGCG-3'    (SEQ ID NO: 2356)

5'-CCAGAAUCUGUUCCAGAGCGUGCGCGA-3'    (SEQ ID NO: 4853)
                 3'-GGUCUUAGACAAGGUCUCGCACGCGCU-5'    (SEQ ID NO: 1952)

AR-1210 Target:  5'-CCAGAATCTGTTCCAGAGCGTGCGCGA-3'    (SEQ ID NO: 2357)

5'-CAGAAUCUGUUCCAGAGCGUGCGCGAA-3'    (SEQ ID NO: 4854)
                 3'-GUCUUAGACAAGGUCUCGCACGCGCUU-5'    (SEQ ID NO: 1953)

AR-1211 Target:  5'-CAGAATCTGTTCCAGAGCGTGCGCGAA-3'    (SEQ ID NO: 2358)

5'-AGAAUCUGUUCCAGAGCGUGCGCGAAG-3'    (SEQ ID NO: 4855)
                 3'-UCUUAGACAAGGUCUCGCACGCGCUUC-5'    (SEQ ID NO: 1954)

AR-1212 Target:  5'-AGAATCTGTTCCAGAGCGTGCGCGAAG-3'    (SEQ ID NO: 2359)

5'-GAAUCUGUUCCAGAGCGUGCGCGAAGU-3'    (SEQ ID NO: 4856)
                 3'-CUUAGACAAGGUCUCGCACGCGCUUCA-5'    (SEQ ID NO: 1955)

AR-1213 Target:  5'-GAATCTGTTCCAGAGCGTGCGCGAAGT-3'    (SEQ ID NO: 2360)

5'-AAUCUGUUCCAGAGCGUGCGCGAAGUG-3'    (SEQ ID NO: 4857)
                 3'-UUAGACAAGGUCUCGCACGCGCUUCAC-5'    (SEQ ID NO: 1956)

AR-1214 Target:  5'-AATCTGTTCCAGAGCGTGCGCGAAGTG-3'    (SEQ ID NO: 2361)

5'-AUCUGUUCCAGAGCGUGCGCGAAGUGA-3'    (SEQ ID NO: 4858)
                 3'-UAGACAAGGUCUCGCACGCGCUUCACU-5'    (SEQ ID NO: 1957)
```

TABLE 7-continued

Selected Human Anti-AR 27mer "Blunt/Blunt" DsiRNA Agents

```
AR-1215 Target:  5'-ATCTGTTCCAGAGCGTGCGCGAAGTGA-3'    (SEQ ID NO: 2362)

5'-UCUGUUCCAGAGCGUGCGCGAAGUGAU-3'   (SEQ ID NO: 4859)
                 3'-AGACAAGGUCUCGCACGCGCUUCACUA-5'   (SEQ ID NO: 1958)

AR-1216 Target:  5'-TCTGTTCCAGAGCGTGCGCGAAGTGAT-3'   (SEQ ID NO: 2363)

5'-CUGUUCCAGAGCGUGCGCGAAGUGAUC-3'  (SEQ ID NO: 4860)
                 3'-GACAAGGUCUCGCACGCGCUUCACUAG-5'  (SEQ ID NO: 1959)

AR-1217 Target:  5'-CTGTTCCAGAGCGTGCGCGAAGTGATC-3'  (SEQ ID NO: 2364)

5'-UGUUCCAGAGCGUGCGCGAAGUGAUCC-3' (SEQ ID NO: 4861)
                 3'-ACAAGGUCUCGCACGCGCUUCACUAGG-5' (SEQ ID NO: 1960)

AR-1218 Target:  5'-TGTTCCAGAGCGTGCGCGAAGTGATCC-3' (SEQ ID NO: 2365)

5'-GGCGCCAGUUUGCUGCUGCUGCAGCAG-3' (SEQ ID NO: 4862)
                 3'-CCGCGGUCAAACGACGACGACGUCGUC-5' (SEQ ID NO: 1961)

AR-1292 Target:  5'-GGCGCCAGTTTGCTGCTGCTGCAGCAG-3' (SEQ ID NO: 2366)

5'-UUGCUGCUGCUGCAGCAGCAGCAGCAG-3' (SEQ ID NO: 4863)
                 3'-AACGACGACGACGUCGUCGUCGUCGUC-5' (SEQ ID NO: 1962)

AR-1301 Target:  5'-TTGCTGCTGCTGCAGCAGCAGCAGCAG-3' (SEQ ID NO: 2367)

5'-GCGUCCCAGAGCCUGGAGCCGCCGUGG-3' (SEQ ID NO: 4864)
                 3'-CGCAGGGUCUCGGACCUCGGCGGCACC-5' (SEQ ID NO: 1963)

AR-1533 Target:  5'-GCGTCCCAGAGCCTGGAGCCGCCGTGG-3' (SEQ ID NO: 2368)

5'-GGCUGCCGCAGCAGCUGCCAGCACCUC-3' (SEQ ID NO: 4865)
                 3'-CCGACGGCGUCGUCGACGGUCGUGGAG-5' (SEQ ID NO: 1964)

AR-1572 Target:  5'-GGCTGCCGCAGCAGCTGCCAGCACCTC-3' (SEQ ID NO: 2369)

5'-CGCAGCAGCUGCCAGCACCUCCGGACG-3' (SEQ ID NO: 4866)
                 3'-GCGUCGUCGACGGUCGUGGAGGCCUGC-5' (SEQ ID NO: 1965)

AR-1578 Target:  5'-CGCAGCAGCTGCCAGCACCTCCGGACG-3' (SEQ ID NO: 2370)

5'-CCCAUCCACGUUGUCCCUGCUGGGCCC-3' (SEQ ID NO: 4867)
                 3'-GGGUAGGUGCAACAGGGACGACCCGGG-5' (SEQ ID NO: 1966)

AR-1621 Target:  5'-CCCATCCACGTTGTCCCTGCTGGGCCC-3' (SEQ ID NO: 2371)

5'-CCGGCUUAAGCAGCUGCUCCGCUGACC-3' (SEQ ID NO: 4868)
                 3'-GGCCGAAUUCGUCGACGAGGCGACUGG-5' (SEQ ID NO: 1967)

AR-1656 Target:  5'-CCGGCTTAAGCAGCTGCTCCGCTGACC-3' (SEQ ID NO: 2372)

5'-CGGCUUAAGCAGCUGCUCCGCUGACCU-3' (SEQ ID NO: 4869)
                 3'-GCCGAAUUCGUCGACGAGGCGACUGGA-5' (SEQ ID NO: 1968)

AR-1657 Target:  5'-CGGCTTAAGCAGCTGCTCCGCTGACCT-3' (SEQ ID NO: 2373)

5'-UAAGCAGCUGCUCCGCUGACCUUAAAG-3' (SEQ ID NO: 4870)
                 3'-AUUCGUCGACGAGGCGACUGGAAUUUC-5' (SEQ ID NO: 1969)

AR-1662 Target:  5'-TAAGCAGCTGCTCCGCTGACCTTAAAG-3' (SEQ ID NO: 2374)

5'-AUGCAACUCCUUCAGCAACAGCAGCAG-3' (SEQ ID NO: 4871)
                 3'-UACGUUGAGGAAGUCGUUGUCGUCGUC-5' (SEQ ID NO: 1970)

AR-1712 Target:  5'-ATGCAACTCCTTCAGCAACAGCAGCAG-3' (SEQ ID NO: 2375)

5'-ACCAUUUCUGACAACGCCAAGGAGUUG-3' (SEQ ID NO: 4872)
                 3'-UGGUAAAGACUGUUGCGGUUCCUCAAC-5' (SEQ ID NO: 1971)

AR-1832 Target:  5'-ACCATTTCTGACAACGCCAAGGAGTTG-3' (SEQ ID NO: 2376)

5'-CCACUUUUGGGAGUUCCACCCGCUGUG-3' (SEQ ID NO: 4873)
                 3'-GGUGAAAACCCUCAAGGUGGGCGACAC-5' (SEQ ID NO: 1972)
```

TABLE 7-continued

Selected Human Anti-AR 27mer "Blunt/Blunt" DsiRNA Agents

```
AR-1952 Target:  5'-CCACTTTTGGGAGTTCCACCCGCTGTG-3'   (SEQ ID NO: 2377)

5'-CAGGCAAGAGCACUGAAGAUACUGCUG-3'   (SEQ ID NO: 4874)
                 3'-GUCCGUUCUCGUGACUUCUAUGACGAC-5'   (SEQ ID NO: 1973)

AR-2037 Target:  5'-CAGGCAAGAGCACTGAAGATACTGCTG-3'   (SEQ ID NO: 2378)

5'-CUGGCAGCGCUGCAGCAGGGAGCUCCG-3'   (SEQ ID NO: 4875)
                 3'-GACCGUCGCGACGUCGUCCCUCGAGGC-5'   (SEQ ID NO: 1974)

AR-2124 Target:  5'-CTGGCAGCGCTGCAGCAGGGAGCTCCG-3'   (SEQ ID NO: 2379)

5'-AGUCGCGACUACUACAACUUUCCACUG-3'   (SEQ ID NO: 4876)
                 3'-UCAGCGCUGAUGAUGUUGAAAGGUGAC-5'   (SEQ ID NO: 1975)

AR-2222 Target:  5'-AGTCGCGACTACTACAACTTTCCACTG-3'   (SEQ ID NO: 2380)

5'-GUCGCGACUACUACAACUUUCCACUGG-3'   (SEQ ID NO: 4877)
                 3'-CAGCGCUGAUGAUGUUGAAAGGUGACC-5'   (SEQ ID NO: 1976)

AR-2223 Target:  5'-GTCGCGACTACTACAACTTTCCACTGG-3'   (SEQ ID NO: 2381)

5'-UCGCGACUACUACAACUUUCCACUGGC-3'   (SEQ ID NO: 4878)
                 3'-AGCGCUGAUGAUGUUGAAAGGUGACCG-5'   (SEQ ID NO: 1977)

AR-2224 Target:  5'-TCGCGACTACTACAACTTTCCACTGGC-3'   (SEQ ID NO: 2382)

5'-GCUCGCAUCAAGCUGGAGAACCCGCUG-3'   (SEQ ID NO: 4879)
                 3'-CGAGCGUAGUUCGACCUCUUGGGCGAC-5'   (SEQ ID NO: 1978)

AR-2294 Target:  5'-GCTCGCATCAAGCTGGAGAACCCGCTG-3'   (SEQ ID NO: 2383)

5'-GCUGGACUACGGCAGCGCCUGGGCGGC-3'   (SEQ ID NO: 4880)
                 3'-CGACCUGAUGCCGUCGCGGACCCGCCG-5'   (SEQ ID NO: 1979)

AR-2317 Target:  5'-GCTGGACTACGGCAGCGCCTGGGCGGC-3'   (SEQ ID NO: 2384)

5'-CUGGACUACGGCAGCGCCUGGGCGGCU-3'   (SEQ ID NO: 4881)
                 3'-GACCUGAUGCCGUCGCGGACCCGCCGA-5'   (SEQ ID NO: 1980)

AR-2318 Target:  5'-CTGGACTACGGCAGCGCCTGGGCGGCT-3'   (SEQ ID NO: 2385)

5'-UGGACUACGGCAGCGCCUGGGCGGCUG-3'   (SEQ ID NO: 4882)
                 3'-ACCUGAUGCCGUCGCGGACCCGCCGAC-5'   (SEQ ID NO: 1981)

AR-2319 Target:  5'-TGGACTACGGCAGCGCCTGGGCGGCTG-3'   (SEQ ID NO: 2386)

5'-GGACUACGGCAGCGCCUGGGCGGCUGC-3'   (SEQ ID NO: 4883)
                 3'-CCUGAUGCCGUCGCGGACCCGCCGACG-5'   (SEQ ID NO: 1982)

AR-2320 Target:  5'-GGACTACGGCAGCGCCTGGGCGGCTGC-3'   (SEQ ID NO: 2387)

5'-UGGCGCGGGUGCAGCGGGACCCGGUUC-3'   (SEQ ID NO: 4884)
                 3'-ACCGCGCCCACGUCGCCCUGGGCCAAG-5'   (SEQ ID NO: 1983)

AR-2386 Target:  5'-TGGCGCGGGTGCAGCGGGACCCGGTTC-3'   (SEQ ID NO: 2388)

5'-GGCUGGCGGGCCAGGAAAGCGACUUCA-3'   (SEQ ID NO: 4885)
                 3'-CCGACCGCCCGGUCCUUUCGCUGAAGU-5'   (SEQ ID NO: 1984)

AR-2607 Target:  5'-GGCTGGCGGGCCAGGAAAGCGACTTCA-3'   (SEQ ID NO: 2389)

5'-GUACCCUGGCGGCAUGGUGAGCAGAGU-3'   (SEQ ID NO: 4886)
                 3'-CAUGGGACCGCCGUACCACUCGUCUCA-5'   (SEQ ID NO: 1985)

AR-2650 Target:  5'-GTACCCTGGCGGCATGGTGAGCAGAGT-3'   (SEQ ID NO: 2390)

5'-UGGAUGGAUAGCUACUCCGGACCUUAC-3'   (SEQ ID NO: 4887)
                 3'-ACCUACCUAUCGAUGAGGCCUGGAAUG-5'   (SEQ ID NO: 1986)

AR-2720 Target:  5'-TGGATGGATAGCTACTCCGGACCTTAC-3'   (SEQ ID NO: 2391)

5'-CCCAGAAGACCUGCCUGAUCUGUGGAG-3'   (SEQ ID NO: 4888)
                 3'-GGGUCUUCUGGACGGACUAGACACCUC-5'   (SEQ ID NO: 1987)
```

TABLE 7-continued

Selected Human Anti-AR 27mer "Blunt/Blunt" DsiRNA Agents

```
AR-2808 Target:  5'-CCCAGAAGACCTGCCTGATCTGTGGAG-3'    (SEQ ID NO: 2392)

5'-CCAGAAGACCUGCCUGAUCUGUGGAGA-3'   (SEQ ID NO: 4889)
                 3'-GGUCUUCUGGACGGACUAGACACCUCU-5'   (SEQ ID NO: 1988)

AR-2809 Target:  5'-CCAGAAGACCTGCCTGATCTGTGGAGA-3'   (SEQ ID NO: 2393)

5'-CAGAAGACCUGCCUGAUCUGUGGAGAU-3'   (SEQ ID NO: 4890)
                 3'-GUCUUCUGGACGGACUAGACACCUCUA-5'   (SEQ ID NO: 1989)

AR-2810 Target:  5'-CAGAAGACCTGCCTGATCTGTGGAGAT-3'   (SEQ ID NO: 2394)

5'-AGAAGACCUGCCUGAUCUGUGGAGAUG-3'   (SEQ ID NO: 4891)
                 3'-UCUUCUGGACGGACUAGACACCUCUAC-5'   (SEQ ID NO: 1990)

AR-2811 Target:  5'-AGAAGACCTGCCTGATCTGTGGAGATG-3'   (SEQ ID NO: 2395)

5'-GAAGACCUGCCUGAUCUGUGGAGAUGA-3'   (SEQ ID NO: 4892)
                 3'-CUUCUGGACGGACUAGACACCUCUACU-5'   (SEQ ID NO: 1991)

AR-2812 Target:  5'-GAAGACCTGCCTGATCTGTGGAGATGA-3'   (SEQ ID NO: 2396)

5'-AAGACCUGCCUGAUCUGUGGAGAUGAA-3'   (SEQ ID NO: 4893)
                 3'-UUCUGGACGGACUAGACACCUCUACUU-5'   (SEQ ID NO: 1992)

AR-2813 Target:  5'-AAGACCTGCCTGATCTGTGGAGATGAA-3'   (SEQ ID NO: 2397)

5'-AGACCUGCCUGAUCUGUGGAGAUGAAG-3'   (SEQ ID NO: 4894)
                 3'-UCUGGACGGACUAGACACCUCUACUUC-5'   (SEQ ID NO: 1993)

AR-2814 Target:  5'-AGACCTGCCTGATCTGTGGAGATGAAG-3'   (SEQ ID NO: 2398)

5'-GACCUGCCUGAUCUGUGGAGAUGAAGC-3'   (SEQ ID NO: 4895)
                 3'-CUGGACGGACUAGACACCUCUACUUCG-5'   (SEQ ID NO: 1994)

AR-2815 Target:  5'-GACCTGCCTGATCTGTGGAGATGAAGC-3'   (SEQ ID NO: 2399)

5'-ACCUGCCUGAUCUGUGGAGAUGAAGCU-3'   (SEQ ID NO: 4896)
                 3'-UGGACGGACUAGACACCUCUACUUCGA-5'   (SEQ ID NO: 1995)

AR-2816 Target:  5'-ACCTGCCTGATCTGTGGAGATGAAGCT-3'   (SEQ ID NO: 2400)

5'-CCUGCCUGAUCUGUGGAGAUGAAGCUU-3'   (SEQ ID NO: 4897)
                 3'-GGACGGACUAGACACCUCUACUUCGAA-5'   (SEQ ID NO: 1996)

AR-2817 Target:  5'-CCTGCCTGATCTGTGGAGATGAAGCTT-3'   (SEQ ID NO: 2401)

5'-CUGCCUGAUCUGUGGAGAUGAAGCUUC-3'   (SEQ ID NO: 4898)
                 3'-GACGGACUAGACACCUCUACUUCGAAG-5'   (SEQ ID NO: 1997)

AR-2818 Target:  5'-CTGCCTGATCTGTGGAGATGAAGCTTC-3'   (SEQ ID NO: 2402)

5'-UGCCUGAUCUGUGGAGAUGAAGCUUCU-3'   (SEQ ID NO: 4899)
                 3'-ACGGACUAGACACCUCUACUUCGAAGA-5'   (SEQ ID NO: 1998)

AR-2819 Target:  5'-TGCCTGATCTGTGGAGATGAAGCTTCT-3'   (SEQ ID NO: 2403)

5'-GCCUGAUCUGUGGAGAUGAAGCUUCUG-3'   (SEQ ID NO: 4900)
                 3'-CGGACUAGACACCUCUACUUCGAAGAC-5'   (SEQ ID NO: 1999)

AR-2820 Target:  5'-GCCTGATCTGTGGAGATGAAGCTTCTG-3'   (SEQ ID NO: 2404)

5'-CCUGAUCUGUGGAGAUGAAGCUUCUGG-3'   (SEQ ID NO: 4901)
                 3'-GGACUAGACACCUCUACUUCGAAGACC-5'   (SEQ ID NO: 2000)

AR-2821 Target:  5'-CCTGATCTGTGGAGATGAAGCTTCTGG-3'   (SEQ ID NO: 2405)

5'-CUGAUCUGUGGAGAUGAAGCUUCUGGG-3'   (SEQ ID NO: 4902)
                 3'-GACUAGACACCUCUACUUCGAAGACCC-5'   (SEQ ID NO: 2001)

AR-2822 Target:  5'-CTGATCTGTGGAGATGAAGCTTCTGGG-3'   (SEQ ID NO: 2406)

5'-UGAUCUGUGGAGAUGAAGCUUCUGGGU-3'   (SEQ ID NO: 4903)
                 3'-ACUAGACACCUCUACUUCGAAGACCCA-5'   (SEQ ID NO: 2002)
```

TABLE 7-continued

Selected Human Anti-AR 27mer "Blunt/Blunt" DsiRNA Agents

```
AR-2823 Target:  5'-TGATCTGTGGAGATGAAGCTTCTGGGT-3'    (SEQ ID NO: 2407)

5'-GAUCUGUGGAGAUGAAGCUUCUGGGUG-3'   (SEQ ID NO: 4904)
                 3'-CUAGACACCUCUACUUCGAAGACCCAC-5'   (SEQ ID NO: 2003)

AR-2824 Target:  5'-GATCTGTGGAGATGAAGCTTCTGGGTG-3'   (SEQ ID NO: 2408)

5'-AUCUGUGGAGAUGAAGCUUCUGGGUGU-3'   (SEQ ID NO: 4905)
                 3'-UAGACACCUCUACUUCGAAGACCCACA-5'   (SEQ ID NO: 2004)

AR-2825 Target:  5'-ATCTGTGGAGATGAAGCTTCTGGGTGT-3'   (SEQ ID NO: 2409)

5'-UCUGUGGAGAUGAAGCUUCUGGGUGUC-3'   (SEQ ID NO: 4906)
                 3'-AGACACCUCUACUUCGAAGACCCACAG-5'   (SEQ ID NO: 2005)

AR-2826 Target:  5'-TCTGTGGAGATGAAGCTTCTGGGTGTC-3'   (SEQ ID NO: 2410)

5'-CUGUGGAGAUGAAGCUUCUGGGUGUCA-3'   (SEQ ID NO: 4907)
                 3'-GACACCUCUACUUCGAAGACCCACAGU-5'   (SEQ ID NO: 2006)

AR-2827 Target:  5'-CTGTGGAGATGAAGCTTCTGGGTGTCA-3'   (SEQ ID NO: 2411)

5'-GCUUCUGGGUGUCACUAUGGAGCUCUC-3'   (SEQ ID NO: 4908)
                 3'-CGAAGACCCACAGUGAUACCUCGAGAG-5'   (SEQ ID NO: 2007)

AR-2840 Target:  5'-GCTTCTGGGTGTCACTATGGAGCTCTC-3'   (SEQ ID NO: 2412)

5'-UGGAGCUCUCACAUGUGGAAGCUGCAA-3'   (SEQ ID NO: 4909)
                 3'-ACCUCGAGAGUGUACACCUUCGACGUU-5'   (SEQ ID NO: 2008)

AR-2857 Target:  5'-TGGAGCTCTCACATGTGGAAGCTGCAA-3'   (SEQ ID NO: 2413)

5'-GAAGCUGCAAGGUCUUCUUCAAAAGAG-3'   (SEQ ID NO: 4910)
                 3'-CUUCGACGUUCCAGAAGAAGUUUUCUC-5'   (SEQ ID NO: 2009)

AR-2874 Target:  5'-GAAGCTGCAAGGTCTTCTTCAAAAGAG-3'   (SEQ ID NO: 2414)

5'-AAGCUGCAAGGUCUUCUUCAAAAGAGC-3'   (SEQ ID NO: 4911)
                 3'-UUCGACGUUCCAGAAGAAGUUUUCUCG-5'   (SEQ ID NO: 2010)

AR-2875 Target:  5'-AAGCTGCAAGGTCTTCTTCAAAAGAGC-3'   (SEQ ID NO: 2415)

5'-AGCUGCAAGGUCUUCUUCAAAAGAGCC-3'   (SEQ ID NO: 4912)
                 3'-UCGACGUUCCAGAAGAAGUUUUCUCGG-5'   (SEQ ID NO: 2011)

AR-2876 Target:  5'-AGCTGCAAGGTCTTCTTCAAAAGAGCC-3'   (SEQ ID NO: 2416)

5'-GCUGCAAGGUCUUCUUCAAAAGAGCCG-3'   (SEQ ID NO: 4913)
                 3'-CGACGUUCCAGAAGAAGUUUUCUCGGC-5'   (SEQ ID NO: 2012)

AR-2877 Target:  5'-GCTGCAAGGTCTTCTTCAAAAGAGCCG-3'   (SEQ ID NO: 2417)

5'-CUGCAAGGUCUUCUUCAAAAGAGCCGC-3'   (SEQ ID NO: 4914)
                 3'-GACGUUCCAGAAGAAGUUUUCUCGGCG-5'   (SEQ ID NO: 2013)

AR-2878 Target:  5'-CTGCAAGGTCTTCTTCAAAAGAGCCGC-3'   (SEQ ID NO: 2418)

5'-UGCAAGGUCUUCUUCAAAAGAGCCGCU-3'   (SEQ ID NO: 4915)
                 3'-ACGUUCCAGAAGAAGUUUUCUCGGCGA-5'   (SEQ ID NO: 2014)

AR-2879 Target:  5'-TGCAAGGTCTTCTTCAAAAGAGCCGCT-3'   (SEQ ID NO: 2419)

5'-GCAAGGUCUUCUUCAAAAGAGCCGCUG-3'   (SEQ ID NO: 4916)
                 3'-CGUUCCAGAAGAAGUUUUCUCGGCGAC-5'   (SEQ ID NO: 2015)

AR-2880 Target:  5'-GCAAGGTCTTCTTCAAAAGAGCCGCTG-3'   (SEQ ID NO: 2420)

5'-CAAGGUCUUCUUCAAAAGAGCCGCUGA-3'   (SEQ ID NO: 4917)
                 3'-GUUCCAGAAGAAGUUUUCUCGGCGACU-5'   (SEQ ID NO: 2016)

AR-2881 Target:  5'-CAAGGTCTTCTTCAAAAGAGCCGCTGA-3'   (SEQ ID NO: 2421)

5'-AAGGUCUUCUUCAAAAGAGCCGCUGAA-3'   (SEQ ID NO: 4918)
                 3'-UUCCAGAAGAAGUUUUCUCGGCGACUU-5'   (SEQ ID NO: 2017)
```

TABLE 7-continued

Selected Human Anti-AR 27mer "Blunt/Blunt" DsiRNA Agents

```
AR-2882 Target:  5'-AAGGTCTTCTTCAAAAGAGCCGCTGAA-3'    (SEQ ID NO: 2422)

5'-AGGUCUUCUUCAAAAGAGCCGCUGAAG-3'   (SEQ ID NO: 4919)
                 3'-UCCAGAAGAAGUUUUCUCGGCGACUUC-5'   (SEQ ID NO: 2018)

AR-2883 Target:  5'-AGGTCTTCTTCAAAAGAGCCGCTGAAG-3'   (SEQ ID NO: 2423)

5'-GGUCUUCUUCAAAAGAGCCGCUGAAGG-3'  (SEQ ID NO: 4920)
                 3'-CCAGAAGAAGUUUUCUCGGCGACUUCC-5'  (SEQ ID NO: 2019)

AR-2884 Target:  5'-GGTCTTCTTCAAAAGAGCCGCTGAAGG-3'  (SEQ ID NO: 2424)

5'-GUCUUCUUCAAAAGAGCCGCUGAAGGG-3' (SEQ ID NO: 4921)
                 3'-CAGAAGAAGUUUUCUCGGCGACUUCCC-5' (SEQ ID NO: 2020)

AR-2885 Target:  5'-GTCTTCTTCAAAAGAGCCGCTGAAGGG-3' (SEQ ID NO: 2425)

5'-UCUUCUUCAAAAGAGCCGCUGAAGGGA-3' (SEQ ID NO: 4922)
                 3'-AGAAGAAGUUUUCUCGGCGACUUCCCU-5' (SEQ ID NO: 2021)

AR-2886 Target:  5'-TCTTCTTCAAAAGAGCCGCTGAAGGGA-3' (SEQ ID NO: 2426)

5'-CUUCUUCAAAAGAGCCGCUGAAGGGAA-3' (SEQ ID NO: 4923)
                 3'-GAAGAAGUUUUCUCGGCGACUUCCCUU-5' (SEQ ID NO: 2022)

AR-2887 Target:  5'-CTTCTTCAAAAGAGCCGCTGAAGGGAA-3' (SEQ ID NO: 2427)

5'-UUCUUCAAAAGAGCCGCUGAAGGGAAA-3' (SEQ ID NO: 4924)
                 3'-AAGAAGUUUUCUCGGCGACUUCCCUUU-5' (SEQ ID NO: 2023)

AR-2888 Target:  5'-TTCTTCAAAAGAGCCGCTGAAGGGAAA-3' (SEQ ID NO: 2428)

5'-UCUUCAAAAGAGCCGCUGAAGGGAAAC-3' (SEQ ID NO: 4925)
                 3'-AGAAGUUUUCUCGGCGACUUCCCUUUG-5' (SEQ ID NO: 2024)

AR-2889 Target:  5'-TCTTCAAAAGAGCCGCTGAAGGGAAAC-3' (SEQ ID NO: 2429)

5'-CUUCAAAAGAGCCGCUGAAGGGAAACA-3' (SEQ ID NO: 4926)
                 3'-GAAGUUUUCUCGGCGACUUCCCUUUGU-5' (SEQ ID NO: 2025)

AR-2890 Target:  5'-CTTCAAAAGAGCCGCTGAAGGGAAACA-3' (SEQ ID NO: 2430)

5'-UUCAAAAGAGCCGCUGAAGGGAAACAG-3' (SEQ ID NO: 4927)
                 3'-AAGUUUUCUCGGCGACUUCCCUUUGUC-5' (SEQ ID NO: 2026)

AR-2891 Target:  5'-TTCAAAAGAGCCGCTGAAGGGAAACAG-3' (SEQ ID NO: 2431)

5'-UCAAAAGAGCCGCUGAAGGGAAACAGA-3' (SEQ ID NO: 4928)
                 3'-AGUUUUCUCGGCGACUUCCCUUUGUCU-5' (SEQ ID NO: 2027)

AR-2892 Target:  5'-TCAAAAGAGCCGCTGAAGGGAAACAGA-3' (SEQ ID NO: 2432)

5'-CAAAAGAGCCGCUGAAGGGAAACAGAA-3' (SEQ ID NO: 4929)
                 3'-GUUUUCUCGGCGACUUCCCUUUGUCUU-5' (SEQ ID NO: 2028)

AR-2893 Target:  5'-CAAAAGAGCCGCTGAAGGGAAACAGAA-3' (SEQ ID NO: 2433)

5'-AAAAGAGCCGCUGAAGGGAAACAGAAG-3' (SEQ ID NO: 4930)
                 3'-UUUUCUCGGCGACUUCCCUUUGUCUUC-5' (SEQ ID NO: 2029)

AR-2894 Target:  5'-AAAAGAGCCGCTGAAGGGAAACAGAAG-3' (SEQ ID NO: 2434)

5'-AAAGAGCCGCUGAAGGGAAACAGAAGU-3' (SEQ ID NO: 4931)
                 3'-UUUCUCGGCGACUUCCCUUUGUCUUCA-5' (SEQ ID NO: 2030)

AR-2895 Target:  5'-AAAGAGCCGCTGAAGGGAAACAGAAGT-3' (SEQ ID NO: 2435)

5'-AAGAGCCGCUGAAGGGAAACAGAAGUA-3' (SEQ ID NO: 4932)
                 3'-UUCUCGGCGACUUCCCUUUGUCUUCAU-5' (SEQ ID NO: 2031)

AR-2896 Target:  5'-AAGAGCCGCTGAAGGGAAACAGAAGTA-3' (SEQ ID NO: 2436)

5'-AGAGCCGCUGAAGGGAAACAGAAGUAC-3' (SEQ ID NO: 4933)
                 3'-UCUCGGCGACUUCCCUUUGUCUUCAUG-5' (SEQ ID NO: 2032)
```

TABLE 7-continued

Selected Human Anti-AR 27mer "Blunt/Blunt" DsiRNA Agents

```
AR-2897 Target:  5'-AGAGCCGCTGAAGGGAAACAGAAGTAC-3'   (SEQ ID NO: 2437)

5'-GAGCCGCUGAAGGGAAACAGAAGUACC-3'  (SEQ ID NO: 4934)
                 3'-CUCGGCGACUUCCCUUUGUCUUCAUGG-5'  (SEQ ID NO: 2033)

AR-2898 Target:  5'-GAGCCGCTGAAGGGAAACAGAAGTACC-3'   (SEQ ID NO: 2438)

5'-AGCCGCUGAAGGGAAACAGAAGUACCU-3'  (SEQ ID NO: 4935)
                 3'-UCGGCGACUUCCCUUUGUCUUCAUGGA-5'  (SEQ ID NO: 2034)

AR-2899 Target:  5'-AGCCGCTGAAGGGAAACAGAAGTACCT-3'   (SEQ ID NO: 2439)

5'-CCGCUGAAGGGAAACAGAAGUACCUGU-3'  (SEQ ID NO: 4936)
                 3'-GGCGACUUCCCUUUGUCUUCAUGGACA-5'  (SEQ ID NO: 2035)

AR-2901 Target:  5'-CCGCTGAAGGGAAACAGAAGTACCTGT-3'   (SEQ ID NO: 2440)

5'-CGCUGAAGGGAAACAGAAGUACCUGUG-3'  (SEQ ID NO: 4937)
                 3'-GCGACUUCCCUUUGUCUUCAUGGACAC-5'  (SEQ ID NO: 2036)

AR-2902 Target:  5'-CGCTGAAGGGAAACAGAAGTACCTGTG-3'   (SEQ ID NO: 2441)

5'-CCUGUGCGCCAGCAGAAAUGAUUGCAC-3'  (SEQ ID NO: 4938)
                 3'-GGACACGCGGUCGUCUUUACUAACGUG-5'  (SEQ ID NO: 2037)

AR-2923 Target:  5'-CCTGTGCGCCAGCAGAAATGATTGCAC-3'   (SEQ ID NO: 2442)

5'-GCAGAAAUGAUUGCACUAUUGAUAAAU-3'  (SEQ ID NO: 4939)
                 3'-CGUCUUUACUAACGUGAUAACUAUUUA-5'  (SEQ ID NO: 2038)

AR-2934 Target:  5'-GCAGAAATGATTGCACTATTGATAAAT-3'   (SEQ ID NO: 2443)

5'-AAUGAUUGCACUAUUGAUAAAUUCCGA-3'  (SEQ ID NO: 4940)
                 3'-UUACUAACGUGAUAACUAUUUAAGGCU-5'  (SEQ ID NO: 2039)

AR-2939 Target:  5'-AATGATTGCACTATTGATAAATTCCGA-3'   (SEQ ID NO: 2444)

5'-CACUAUUGAUAAAUUCCGAAGGAAAAA-3'  (SEQ ID NO: 4941)
                 3'-GUGAUAACUAUUUAAGGCUUCCUUUUU-5'  (SEQ ID NO: 2040)

AR-2947 Target:  5'-CACTATTGATAAATTCCGAAGGAAAAA-3'   (SEQ ID NO: 2445)

5'-UUCGGAAAUGUUAUGAAGCAGGGAUGA-3'  (SEQ ID NO: 4942)
                 3'-AAGCCUUUACAAUACUUCGUCCCUACU-5'  (SEQ ID NO: 2041)

AR-2991 Target:  5'-TTCGGAAATGTTATGAAGCAGGGATGA-3'   (SEQ ID NO: 2446)

5'-UCGGAAAUGUUAUGAAGCAGGGAUGAC-3'  (SEQ ID NO: 4943)
                 3'-AGCCUUUACAAUACUUCGUCCCUACUG-5'  (SEQ ID NO: 2042)

AR-2992 Target:  5'-TCGGAAATGTTATGAAGCAGGGATGAC-3'   (SEQ ID NO: 2447)

5'-CGGAAAUGUUAUGAAGCAGGGAUGACU-3'  (SEQ ID NO: 4944)
                 3'-GCCUUUACAAUACUUCGUCCCUACUGA-5'  (SEQ ID NO: 2043)

AR-2993 Target:  5'-CGGAAATGTTATGAAGCAGGGATGACT-3'   (SEQ ID NO: 2448)

5'-GGAAAUGUUAUGAAGCAGGGAUGACUC-3'  (SEQ ID NO: 4945)
                 3'-CCUUUACAAUACUUCGUCCCUACUGAG-5'  (SEQ ID NO: 2044)

AR-2994 Target:  5'-GGAAATGTTATGAAGCAGGGATGACTC-3'   (SEQ ID NO: 2449)

5'-GAAAUGUUAUGAAGCAGGGAUGACUCU-3'  (SEQ ID NO: 4946)
                 3'-CUUUACAAUACUUCGUCCCUACUGAGA-5'  (SEQ ID NO: 2045)

AR-2995 Target:  5'-GAAATGTTATGAAGCAGGGATGACTCT-3'   (SEQ ID NO: 2450)

5'-AAAUGUUAUGAAGCAGGGAUGACUCUG-3'  (SEQ ID NO: 4947)
                 3'-UUUACAAUACUUCGUCCCUACUGAGAC-5'  (SEQ ID NO: 2046)

AR-2996 Target:  5'-AAATGTTATGAAGCAGGGATGACTCTG-3'   (SEQ ID NO: 2451)

5'-AAUGUUAUGAAGCAGGGAUGACUCUGG-3'  (SEQ ID NO: 4948)
                 3'-UUACAAUACUUCGUCCCUACUGAGACC-5'  (SEQ ID NO: 2047)
```

TABLE 7-continued

Selected Human Anti-AR 27mer "Blunt/Blunt" DsiRNA Agents

```
AR-2997 Target:   5'-AATGTTATGAAGCAGGGATGACTCTGG-3'    (SEQ ID NO: 2452)

5'-AUGUUAUGAAGCAGGGAUGACUCUGGG-3'    (SEQ ID NO: 4949)
                  3'-UACAAUACUUCGUCCCUACUGAGACCC-5'    (SEQ ID NO: 2048)

AR-2998 Target:   5'-ATGTTATGAAGCAGGGATGACTCTGGG-3'    (SEQ ID NO: 2453)

5'-UGUUAUGAAGCAGGGAUGACUCUGGGA-3'    (SEQ ID NO: 4950)
                  3'-ACAAUACUUCGUCCCUACUGAGACCCU-5'    (SEQ ID NO: 2049)

AR-2999 Target:   5'-TGTTATGAAGCAGGGATGACTCTGGGA-3'    (SEQ ID NO: 2454)

5'-GUUAUGAAGCAGGGAUGACUCUGGGAG-3'    (SEQ ID NO: 4951)
                  3'-CAAUACUUCGUCCCUACUGAGACCCUC-5'    (SEQ ID NO: 2050)

AR-3000 Target:   5'-GTTATGAAGCAGGGATGACTCTGGGAG-3'    (SEQ ID NO: 2455)

5'-UUAUGAAGCAGGGAUGACUCUGGGAGC-3'    (SEQ ID NO: 4952)
                  3'-AAUACUUCGUCCCUACUGAGACCCUCG-5'    (SEQ ID NO: 2051)

AR-3001 Target:   5'-TTATGAAGCAGGGATGACTCTGGGAGC-3'    (SEQ ID NO: 2456)

5'-UAUGAAGCAGGGAUGACUCUGGGAGCC-3'    (SEQ ID NO: 4953)
                  3'-AUACUUCGUCCCUACUGAGACCCUCGG-5'    (SEQ ID NO: 2052)

AR-3002 Target:   5'-TATGAAGCAGGGATGACTCTGGGAGCC-3'    (SEQ ID NO: 2457)

5'-AUGAAGCAGGGAUGACUCUGGGAGCCC-3'    (SEQ ID NO: 4954)
                  3'-UACUUCGUCCCUACUGAGACCCUCGGG-5'    (SEQ ID NO: 2053)

AR-3003 Target:   5'-ATGAAGCAGGGATGACTCTGGGAGCCC-3'    (SEQ ID NO: 2458)

5'-UGAAGCAGGGAUGACUCUGGGAGCCCG-3'    (SEQ ID NO: 4955)
                  3'-ACUUCGUCCCUACUGAGACCCUCGGGC-5'    (SEQ ID NO: 2054)

AR-3004 Target:   5'-TGAAGCAGGGATGACTCTGGGAGCCCG-3'    (SEQ ID NO: 2459)

5'-GAAGCAGGGAUGACUCUGGGAGCCCGG-3'    (SEQ ID NO: 4956)
                  3'-CUUCGUCCCUACUGAGACCCUCGGGCC-5'    (SEQ ID NO: 2055)

AR-3005 Target:   5'-GAAGCAGGGATGACTCTGGGAGCCCGG-3'    (SEQ ID NO: 2460)

5'-AAGCAGGGAUGACUCUGGGAGCCCGGA-3'    (SEQ ID NO: 4957)
                  3'-UUCGUCCCUACUGAGACCCUCGGGCCU-5'    (SEQ ID NO: 2056)

AR-3006 Target:   5'-AAGCAGGGATGACTCTGGGAGCCCGGA-3'    (SEQ ID NO: 2461)

5'-AGCAGGGAUGACUCUGGGAGCCCGGAA-3'    (SEQ ID NO: 4958)
                  3'-UCGUCCCUACUGAGACCCUCGGGCCUU-5'    (SEQ ID NO: 2057)

AR-3007 Target:   5'-AGCAGGGATGACTCTGGGAGCCCGGAA-3'    (SEQ ID NO: 2462)

5'-CUGAAGAAACUUGGUAAUCUGAAACUA-3'    (SEQ ID NO: 4959)
                  3'-GACUUCUUUGAACCAUUAGACUUUGAU-5'    (SEQ ID NO: 2058)

AR-3035 Target:   5'-CTGAAGAAACTTGGTAATCTGAAACTA-3'    (SEQ ID NO: 2463)

5'-UGAAACUACAGGAGGAAGGAGAGGCUU-3'    (SEQ ID NO: 4960)
                  3'-ACUUUGAUGUCCUCCUUCCUCUCCGAA-5'    (SEQ ID NO: 2059)

AR-3054 Target:   5'-TGAAACTACAGGAGGAAGGAGAGGCTT-3'    (SEQ ID NO: 2464)

5'-GAAACUACAGGAGGAAGGAGAGGCUUC-3'    (SEQ ID NO: 4961)
                  3'-CUUUGAUGUCCUCCUUCCUCUCCGAAG-5'    (SEQ ID NO: 2060)

AR-3055 Target:   5'-GAAACTACAGGAGGAAGGAGAGGCTTC-3'    (SEQ ID NO: 2465)

5'-CACAUUGAAGGCUAUGAAUGUCAGCCC-3'    (SEQ ID NO: 4962)
                  3'-GUGUAACUUCCGAUACUUACAGUCGGG-5'    (SEQ ID NO: 2061)

AR-3131 Target:   5'-CACATTGAAGGCTATGAATGTCAGCCC-3'    (SEQ ID NO: 2466)

5'-ACAUUGAAGGCUAUGAAUGUCAGCCCA-3'    (SEQ ID NO: 4963)
                  3'-UGUAACUUCCGAUACUUACAGUCGGGU-5'    (SEQ ID NO: 2062)
```

TABLE 7-continued

Selected Human Anti-AR 27mer "Blunt/Blunt" DsiRNA Agents

```
AR-3132 Target:  5'-ACATTGAAGGCTATGAATGTCAGCCCA-3'    (SEQ ID NO: 2467)

5'-CAUUGAAGGCUAUGAAUGUCAGCCCAU-3'    (SEQ ID NO: 4964)
                 3'-GUAACUUCCGAUACUUACAGUCGGGUA-5'    (SEQ ID NO: 2063)

AR-3133 Target:  5'-CATTGAAGGCTATGAATGTCAGCCCAT-3'    (SEQ ID NO: 2468)

5'-AUUGAAGGCUAUGAAUGUCAGCCCAUC-3'    (SEQ ID NO: 4965)
                 3'-UAACUUCCGAUACUUACAGUCGGGUAG-5'    (SEQ ID NO: 2064)

AR-3134 Target:  5'-ATTGAAGGCTATGAATGTCAGCCCATC-3'    (SEQ ID NO: 2469)

5'-UUGAAGGCUAUGAAUGUCAGCCCAUCU-3'    (SEQ ID NO: 4966)
                 3'-AACUUCCGAUACUUACAGUCGGGUAGA-5'    (SEQ ID NO: 2065)

AR-3135 Target:  5'-TTGAAGGCTATGAATGTCAGCCCATCT-3'    (SEQ ID NO: 2470)

5'-UGAAGGCUAUGAAUGUCAGCCCAUCUU-3'    (SEQ ID NO: 4967)
                 3'-ACUUCCGAUACUUACAGUCGGGUAGAA-5'    (SEQ ID NO: 2066)

AR-3136 Target:  5'-TGAAGGCTATGAATGTCAGCCCATCTT-3'    (SEQ ID NO: 2471)

5'-AUGUCCUGGAAGCCAUUGAGCCAGGUG-3'    (SEQ ID NO: 4968)
                 3'-UACAGGACCUUCGGUAACUCGGUCCAC-5'    (SEQ ID NO: 2067)

AR-3168 Target:  5'-ATGTCCTGGAAGCCATTGAGCCAGGTG-3'    (SEQ ID NO: 2472)

5'-UGUCCUGGAAGCCAUUGAGCCAGGUGU-3'    (SEQ ID NO: 4969)
                 3'-ACAGGACCUUCGGUAACUCGGUCCACA-5'    (SEQ ID NO: 2068)

AR-3169 Target:  5'-TGTCCTGGAAGCCATTGAGCCAGGTGT-3'    (SEQ ID NO: 2473)

5'-GUCCUGGAAGCCAUUGAGCCAGGUGUA-3'    (SEQ ID NO: 4970)
                 3'-CAGGACCUUCGGUAACUCGGUCCACAU-5'    (SEQ ID NO: 2069)

AR-3170 Target:  5'-GTCCTGGAAGCCATTGAGCCAGGTGTA-3'    (SEQ ID NO: 2474)

5'-UCCUGGAAGCCAUUGAGCCAGGUGUAG-3'    (SEQ ID NO: 4971)
                 3'-AGGACCUUCGGUAACUCGGUCCACAUC-5'    (SEQ ID NO: 2070)

AR-3171 Target:  5'-TCCTGGAAGCCATTGAGCCAGGTGTAG-3'    (SEQ ID NO: 2475)

5'-CCUGGAAGCCAUUGAGCCAGGUGUAGU-3'    (SEQ ID NO: 4972)
                 3'-GGACCUUCGGUAACUCGGUCCACAUCA-5'    (SEQ ID NO: 2071)

AR-3172 Target:  5'-CCTGGAAGCCATTGAGCCAGGTGTAGT-3'    (SEQ ID NO: 2476)

5'-ACCAGCCCGACUCCUUUGCAGCCUUGC-3'    (SEQ ID NO: 4973)
                 3'-UGGUCGGGCUGAGGAAACGUCGGAACG-5'    (SEQ ID NO: 2072)

AR-3219 Target:  5'-ACCAGCCCGACTCCTTTGCAGCCTTGC-3'    (SEQ ID NO: 2477)

5'-CCGACUCCUUUGCAGCCUUGCUCUCUA-3'    (SEQ ID NO: 4974)
                 3'-GGCUGAGGAAACGUCGGAACGAGAGAU-5'    (SEQ ID NO: 2073)

AR-3225 Target:  5'-CCGACTCCTTTGCAGCCTTGCTCTCTA-3'    (SEQ ID NO: 2478)

5'-UGCAGCCUUGCUCUCUAGCCUCAAUGA-3'    (SEQ ID NO: 4975)
                 3'-ACGUCGGAACGAGAGAUCGGAGUUACU-5'    (SEQ ID NO: 2074)

AR-3235 Target:  5'-TGCAGCCTTGCTCTCTAGCCTCAATGA-3'    (SEQ ID NO: 2479)

5'-ACGUGGUCAAGUGGGCCAAGGCCUUGC-3'    (SEQ ID NO: 4976)
                 3'-UGCACCAGUUCACCCGGUUCCGGAACG-5'    (SEQ ID NO: 2075)

AR-3285 Target:  5'-ACGTGGTCAAGTGGGCCAAGGCCTTGC-3'    (SEQ ID NO: 2480)

5'-CGUGGUCAAGUGGGCCAAGGCCUUGCC-3'    (SEQ ID NO: 4977)
                 3'-GCACCAGUUCACCCGGUUCCGGAACGG-5'    (SEQ ID NO: 2076)

AR-3286 Target:  5'-CGTGGTCAAGTGGGCCAAGGCCTTGCC-3'    (SEQ ID NO: 2481)

5'-GUGGUCAAGUGGGCCAAGGCCUUGCCU-3'    (SEQ ID NO: 4978)
                 3'-CACCAGUUCACCCGGUUCCGGAACGGA-5'    (SEQ ID NO: 2077)
```

TABLE 7-continued

Selected Human Anti-AR 27mer "Blunt/Blunt" DsiRNA Agents

```
AR-3287 Target:  5'-GTGGTCAAGTGGGCCAAGGCCTTGCCT-3'   (SEQ ID NO: 2482)

5'-UGGUCAAGUGGGCCAAGGCCUUGCCUG-3'  (SEQ ID NO: 4979)
                 3'-ACCAGUUCACCCGGUUCCGGAACGGAC-5'  (SEQ ID NO: 2078)

AR-3288 Target:  5'-TGGTCAAGTGGGCCAAGGCCTTGCCTG-3'   (SEQ ID NO: 2483)

5'-GGUCAAGUGGGCCAAGGCCUUGCCUGG-3'  (SEQ ID NO: 4980)
                 3'-CCAGUUCACCCGGUUCCGGAACGGACC-5'  (SEQ ID NO: 2079)

AR-3289 Target:  5'-GGTCAAGTGGGCCAAGGCCTTGCCTGG-3'   (SEQ ID NO: 2484)

5'-GUCAAGUGGGCCAAGGCCUUGCCUGGC-3'  (SEQ ID NO: 4981)
                 3'-CAGUUCACCCGGUUCCGGAACGGACCG-5'  (SEQ ID NO: 2080)

AR-3290 Target:  5'-GTCAAGTGGGCCAAGGCCTTGCCTGGC-3'   (SEQ ID NO: 2485)

5'-UCAAGUGGGCCAAGGCCUUGCCUGGCU-3'  (SEQ ID NO: 4982)
                 3'-AGUUCACCCGGUUCCGGAACGGACCGA-5'  (SEQ ID NO: 2081)

AR-3291 Target:  5'-TCAAGTGGGCCAAGGCCTTGCCTGGCT-3'   (SEQ ID NO: 2486)

5'-CAAGUGGGCCAAGGCCUUGCCUGGCUU-3'  (SEQ ID NO: 4983)
                 3'-GUUCACCCGGUUCCGGAACGGACCGAA-5'  (SEQ ID NO: 2082)

AR-3292 Target:  5'-CAAGTGGGCCAAGGCCTTGCCTGGCTT-3'   (SEQ ID NO: 2487)

5'-AAGUGGGCCAAGGCCUUGCCUGGCUUC-3'  (SEQ ID NO: 4984)
                 3'-UUCACCCGGUUCCGGAACGGACCGAAG-5'  (SEQ ID NO: 2083)

AR-3293 Target:  5'-AAGTGGGCCAAGGCCTTGCCTGGCTTC-3'   (SEQ ID NO: 2488)

5'-AGUGGGCCAAGGCCUUGCCUGGCUUCC-3'  (SEQ ID NO: 4985)
                 3'-UCACCCGGUUCCGGAACGGACCGAAGG-5'  (SEQ ID NO: 2084)

AR-3294 Target:  5'-AGTGGGCCAAGGCCTTGCCTGGCTTCC-3'   (SEQ ID NO: 2489)

5'-GUGGGCCAAGGCCUUGCCUGGCUUCCG-3'  (SEQ ID NO: 4986)
                 3'-CACCCGGUUCCGGAACGGACCGAAGGC-5'  (SEQ ID NO: 2085)

AR-3295 Target:  5'-GTGGGCCAAGGCCTTGCCTGGCTTCCG-3'   (SEQ ID NO: 2490)

5'-UGGGCCAAGGCCUUGCCUGGCUUCCGC-3'  (SEQ ID NO: 4987)
                 3'-ACCCGGUUCCGGAACGGACCGAAGGCG-5'  (SEQ ID NO: 2086)

AR-3296 Target:  5'-TGGGCCAAGGCCTTGCCTGGCTTCCGC-3'   (SEQ ID NO: 2491)

5'-GGGCCAAGGCCUUGCCUGGCUUCCGCA-3'  (SEQ ID NO: 4988)
                 3'-CCCGGUUCCGGAACGGACCGAAGGCGU-5'  (SEQ ID NO: 2087)

AR-3297 Target:  5'-GGGCCAAGGCCTTGCCTGGCTTCCGCA-3'   (SEQ ID NO: 2492)

5'-GGCCAAGGCCUUGCCUGGCUUCCGCAA-3'  (SEQ ID NO: 4989)
                 3'-CCGGUUCCGGAACGGACCGAAGGCGUU-5'  (SEQ ID NO: 2088)

AR-3298 Target:  5'-GGCCAAGGCCTTGCCTGGCTTCCGCAA-3'   (SEQ ID NO: 2493)

5'-GCCAAGGCCUUGCCUGGCUUCCGCAAC-3'  (SEQ ID NO: 4990)
                 3'-CGGUUCCGGAACGGACCGAAGGCGUUG-5'  (SEQ ID NO: 2089)

AR-3299 Target:  5'-GCCAAGGCCTTGCCTGGCTTCCGCAAC-3'   (SEQ ID NO: 2494)

5'-CCAAGGCCUUGCCUGGCUUCCGCAACU-3'  (SEQ ID NO: 4991)
                 3'-GGUUCCGGAACGGACCGAAGGCGUUGA-5'  (SEQ ID NO: 2090)

AR-3300 Target:  5'-CCAAGGCCTTGCCTGGCTTCCGCAACT-3'   (SEQ ID NO: 2495)

5'-CAAGGCCUUGCCUGGCUUCCGCAACUU-3'  (SEQ ID NO: 4992)
                 3'-GUUCCGGAACGGACCGAAGGCGUUGAA-5'  (SEQ ID NO: 2091)

AR-3301 Target:  5'-CAAGGCCTTGCCTGGCTTCCGCAACTT-3'   (SEQ ID NO: 2496)

5'-AAGGCCUUGCCUGGCUUCCGCAACUUA-3'  (SEQ ID NO: 4993)
                 3'-UUCCGGAACGGACCGAAGGCGUUGAAU-5'  (SEQ ID NO: 2092)
```

TABLE 7-continued

Selected Human Anti-AR 27mer "Blunt/Blunt" DsiRNA Agents

```
AR-3302 Target:   5'-AAGGCCTTGCCTGGCTTCCGCAACTTA-3'    (SEQ ID NO: 2497)

5'-AGGCCUUGCCUGGCUUCCGCAACUUAC-3'    (SEQ ID NO: 4994)
                  3'-UCCGGAACGGACCGAAGGCGUUGAAUG-5'    (SEQ ID NO: 2093)

AR-3303 Target:   5'-AGGCCTTGCCTGGCTTCCGCAACTTAC-3'    (SEQ ID NO: 2498)

5'-GGCCUUGCCUGGCUUCCGCAACUUACA-3'    (SEQ ID NO: 4995)
                  3'-CCGGAACGGACCGAAGGCGUUGAAUGU-5'    (SEQ ID NO: 2094)

AR-3304 Target:   5'-GGCCTTGCCTGGCTTCCGCAACTTACA-3'    (SEQ ID NO: 2499)

5'-GCCUUGCCUGGCUUCCGCAACUUACAC-3'    (SEQ ID NO: 4996)
                  3'-CGGAACGGACCGAAGGCGUUGAAUGUG-5'    (SEQ ID NO: 2095)

AR-3305 Target:   5'-GCCTTGCCTGGCTTCCGCAACTTACAC-3'    (SEQ ID NO: 2500)

5'-CCUUGCCUGGCUUCCGCAACUUACACG-3'    (SEQ ID NO: 4997)
                  3'-GGAACGGACCGAAGGCGUUGAAUGUGC-5'    (SEQ ID NO: 2096)

AR-3306 Target:   5'-CCTTGCCTGGCTTCCGCAACTTACACG-3'    (SEQ ID NO: 2501)

5'-CUUGCCUGGCUUCCGCAACUUACACGU-3'    (SEQ ID NO: 4998)
                  3'-GAACGGACCGAAGGCGUUGAAUGUGCA-5'    (SEQ ID NO: 2097)

AR-3307 Target:   5'-CTTGCCTGGCTTCCGCAACTTACACGT-3'    (SEQ ID NO: 2502)

5'-CCAAUGUCAACUCCAGGAUGCUCUACU-3'    (SEQ ID NO: 4999)
                  3'-GGUUACAGUUGAGGUCCUACGAGAUGA-5'    (SEQ ID NO: 2098)

AR-3408 Target:   5'-CCAATGTCAACTCCAGGATGCTCTACT-3'    (SEQ ID NO: 2503)

5'-CAAUGUCAACUCCAGGAUGCUCUACUU-3'    (SEQ ID NO: 5000)
                  3'-GUUACAGUUGAGGUCCUACGAGAUGAA-5'    (SEQ ID NO: 2099)

AR-3409 Target:   5'-CAATGTCAACTCCAGGATGCTCTACTT-3'    (SEQ ID NO: 2504)

5'-AAUGUCAACUCCAGGAUGCUCUACUUC-3'    (SEQ ID NO: 5001)
                  3'-UUACAGUUGAGGUCCUACGAGAUGAAG-5'    (SEQ ID NO: 2100)

AR-3410 Target:   5'-AATGTCAACTCCAGGATGCTCTACTTC-3'    (SEQ ID NO: 2505)

5'-AUGUCAACUCCAGGAUGCUCUACUUCG-3'    (SEQ ID NO: 5002)
                  3'-UACAGUUGAGGUCCUACGAGAUGAAGC-5'    (SEQ ID NO: 2101)

AR-3411 Target:   5'-ATGTCAACTCCAGGATGCTCTACTTCG-3'    (SEQ ID NO: 2506)

5'-UGUCAACUCCAGGAUGCUCUACUUCGC-3'    (SEQ ID NO: 5003)
                  3'-ACAGUUGAGGUCCUACGAGAUGAAGCG-5'    (SEQ ID NO: 2102)

AR-3412 Target:   5'-TGTCAACTCCAGGATGCTCTACTTCGC-3'    (SEQ ID NO: 2507)

5'-GUCAACUCCAGGAUGCUCUACUUCGCC-3'    (SEQ ID NO: 5004)
                  3'-CAGUUGAGGUCCUACGAGAUGAAGCGG-5'    (SEQ ID NO: 2103)

AR-3413 Target:   5'-GTCAACTCCAGGATGCTCTACTTCGCC-3'    (SEQ ID NO: 2508)

5'-UCAACUCCAGGAUGCUCUACUUCGCCC-3'    (SEQ ID NO: 5005)
                  3'-AGUUGAGGUCCUACGAGAUGAAGCGGG-5'    (SEQ ID NO: 2104)

AR-3414 Target:   5'-TCAACTCCAGGATGCTCTACTTCGCCC-3'    (SEQ ID NO: 2509)

5'-UCUGGUUUUCAAUGAGUACCGCAUGCA-3'    (SEQ ID NO: 5006)
                  3'-AGACCAAAAGUUACUCAUGGCGUACGU-5'    (SEQ ID NO: 2105)

AR-3445 Target:   5'-TCTGGTTTTCAATGAGTACCGCATGCA-3'    (SEQ ID NO: 2510)

5'-CUGGUUUUCAAUGAGUACCGCAUGCAC-3'    (SEQ ID NO: 5007)
                  3'-GACCAAAAGUUACUCAUGGCGUACGUG-5'    (SEQ ID NO: 2106)

AR-3446 Target:   5'-CTGGTTTTCAATGAGTACCGCATGCAC-3'    (SEQ ID NO: 2511)

5'-UGGUUUUCAAUGAGUACCGCAUGCACA-3'    (SEQ ID NO: 5008)
                  3'-ACCAAAAGUUACUCAUGGCGUACGUGU-5'    (SEQ ID NO: 2107)
```

TABLE 7-continued

Selected Human Anti-AR 27mer "Blunt/Blunt" DsiRNA Agents

```
AR-3447  Target:  5'-TGGTTTTCAATGAGTACCGCATGCACA-3'    (SEQ ID NO: 2512)

5'-GGUUUUCAAUGAGUACCGCAUGCACAA-3'   (SEQ ID NO: 5009)
                  3'-CCAAAAGUUACUCAUGGCGUACGUGUU-5'   (SEQ ID NO: 2108)

AR-3448  Target:  5'-GGTTTTCAATGAGTACCGCATGCACAA-3'   (SEQ ID NO: 2513)

5'-GUUUUCAAUGAGUACCGCAUGCACAAG-3'  (SEQ ID NO: 5010)
                  3'-CAAAAGUUACUCAUGGCGUACGUGUUC-5'  (SEQ ID NO: 2109)

AR-3449  Target:  5'-GTTTTCAATGAGTACCGCATGCACAAG-3'  (SEQ ID NO: 2514)

5'-UUUUCAAUGAGUACCGCAUGCACAAGU-3' (SEQ ID NO: 5011)
                  3'-AAAAGUUACUCAUGGCGUACGUGUUCA-5' (SEQ ID NO: 2110)

AR-3450  Target:  5'-TTTTCAATGAGTACCGCATGCACAAGT-3' (SEQ ID NO: 2515)

5'-UUUCAAUGAGUACCGCAUGCACAAGUC-3' (SEQ ID NO: 5012)
                  3'-AAAGUUACUCAUGGCGUACGUGUUCAG-5' (SEQ ID NO: 2111)

AR-3451  Target:  5'-TTTCAATGAGTACCGCATGCACAAGTC-3' (SEQ ID NO: 2516)

5'-UUCAAUGAGUACCGCAUGCACAAGUCC-3' (SEQ ID NO: 5013)
                  3'-AAGUUACUCAUGGCGUACGUGUUCAGG-5' (SEQ ID NO: 2112)

AR-3452  Target:  5'-TTCAATGAGTACCGCATGCACAAGTCC-3' (SEQ ID NO: 2517)

5'-UCAAUGAGUACCGCAUGCACAAGUCCC-3' (SEQ ID NO: 5014)
                  3'-AGUUACUCAUGGCGUACGUGUUCAGGG-5' (SEQ ID NO: 2113)

AR-3453  Target:  5'-TCAATGAGTACCGCATGCACAAGTCCC-3' (SEQ ID NO: 2518)

5'-CAAUGAGUACCGCAUGCACAAGUCCCG-3' (SEQ ID NO: 5015)
                  3'-GUUACUCAUGGCGUACGUGUUCAGGGC-5' (SEQ ID NO: 2114)

AR-3454  Target:  5'-CAATGAGTACCGCATGCACAAGTCCCG-3' (SEQ ID NO: 2519)

5'-AAUGAGUACCGCAUGCACAAGUCCCGG-3' (SEQ ID NO: 5016)
                  3'-UUACUCAUGGCGUACGUGUUCAGGGCC-5' (SEQ ID NO: 2115)

AR-3455  Target:  5'-AATGAGTACCGCATGCACAAGTCCCGG-3' (SEQ ID NO: 2520)

5'-AUGAGUACCGCAUGCACAAGUCCCGGA-3' (SEQ ID NO: 5017)
                  3'-UACUCAUGGCGUACGUGUUCAGGGCCU-5' (SEQ ID NO: 2116)

AR-3456  Target:  5'-ATGAGTACCGCATGCACAAGTCCCGGA-3' (SEQ ID NO: 2521)

5'-UGAGUACCGCAUGCACAAGUCCCGGAU-3' (SEQ ID NO: 5018)
                  3'-ACUCAUGGCGUACGUGUUCAGGGCCUA-5' (SEQ ID NO: 2117)

AR-3457  Target:  5'-TGAGTACCGCATGCACAAGTCCCGGAT-3' (SEQ ID NO: 2522)

5'-UCUCUCAAGAGUUUGGAUGGCUCCAAA-3' (SEQ ID NO: 5019)
                  3'-AGAGAGUUCUCAAACCUACCGAGGUUU-5' (SEQ ID NO: 2118)

AR-3513  Target:  5'-TCTCTCAAGAGTTTGGATGGCTCCAAA-3' (SEQ ID NO: 2523)

5'-CUCUCAAGAGUUUGGAUGGCUCCAAAU-3' (SEQ ID NO: 5020)
                  3'-GAGAGUUCUCAAACCUACCGAGGUUUA-5' (SEQ ID NO: 2119)

AR-3514  Target:  5'-CTCTCAAGAGTTTGGATGGCTCCAAAT-3' (SEQ ID NO: 2524)

5'-UCUCAAGAGUUUGGAUGGCUCCAAAUC-3' (SEQ ID NO: 5021)
                  3'-AGAGUUCUCAAACCUACCGAGGUUUAG-5' (SEQ ID NO: 2120)

AR-3515  Target:  5'-TCTCAAGAGTTTGGATGGCTCCAAATC-3' (SEQ ID NO: 2525)

5'-CUCAAGAGUUUGGAUGGCUCCAAAUCA-3' (SEQ ID NO: 5022)
                  3'-GAGUUCUCAAACCUACCGAGGUUUAGU-5' (SEQ ID NO: 2121)

AR-3516  Target:  5'-CTCAAGAGTTTGGATGGCTCCAAATCA-3' (SEQ ID NO: 2526)

5'-UCAAGAGUUUGGAUGGCUCCAAAUCAC-3' (SEQ ID NO: 5023)
                  3'-AGUUCUCAAACCUACCGAGGUUUAGUG-5' (SEQ ID NO: 2122)
```

TABLE 7-continued

Selected Human Anti-AR 27mer "Blunt/Blunt" DsiRNA Agents

```
AR-3517 Target:  5'-TCAAGAGTTTGGATGGCTCCAAATCAC-3'    (SEQ ID NO: 2527)

5'-CAAGAGUUUGGAUGGCUCCAAAUCACC-3'   (SEQ ID NO: 5024)
                 3'-GUUCUCAAACCUACCGAGGUUUAGUGG-5'   (SEQ ID NO: 2123)

AR-3518 Target:  5'-CAAGAGTTTGGATGGCTCCAAATCACC-3'   (SEQ ID NO: 2528)

5'-AAGAGUUUGGAUGGCUCCAAAUCACCC-3'   (SEQ ID NO: 5025)
                 3'-UUCUCAAACCUACCGAGGUUUAGUGGG-5'   (SEQ ID NO: 2124)

AR-3519 Target:  5'-AAGAGTTTGGATGGCTCCAAATCACCC-3'   (SEQ ID NO: 2529)

5'-CCCAGGAAUUCCUGUGCAUGAAAGCAC-3'   (SEQ ID NO: 5026)
                 3'-GGGUCCUUAAGGACACGUACUUUCGUG-5'   (SEQ ID NO: 2125)

AR-3546 Target:  5'-CCCAGGAATTCCTGTGCATGAAAGCAC-3'   (SEQ ID NO: 2530)

5'-CCAGGAAUUCCUGUGCAUGAAAGCACU-3'   (SEQ ID NO: 5027)
                 3'-GGUCCUUAAGGACACGUACUUUCGUGA-5'   (SEQ ID NO: 2126)

AR-3547 Target:  5'-CCAGGAATTCCTGTGCATGAAAGCACT-3'   (SEQ ID NO: 2531)

5'-CAGGAAUUCCUGUGCAUGAAAGCACUG-3'   (SEQ ID NO: 5028)
                 3'-GUCCUUAAGGACACGUACUUUCGUGAC-5'   (SEQ ID NO: 2127)

AR-3548 Target:  5'-CAGGAATTCCTGTGCATGAAAGCACTG-3'   (SEQ ID NO: 2532)

5'-AGGAAUUCCUGUGCAUGAAAGCACUGC-3'   (SEQ ID NO: 5029)
                 3'-UCCUUAAGGACACGUACUUUCGUGACG-5'   (SEQ ID NO: 2128)

AR-3549 Target:  5'-AGGAATTCCTGTGCATGAAAGCACTGC-3'   (SEQ ID NO: 2533)

5'-GGAAUUCCUGUGCAUGAAAGCACUGCU-3'   (SEQ ID NO: 5030)
                 3'-CCUUAAGGACACGUACUUUCGUGACGA-5'   (SEQ ID NO: 2129)

AR-3550 Target:  5'-GGAATTCCTGTGCATGAAAGCACTGCT-3'   (SEQ ID NO: 2534)

5'-GAAUUCCUGUGCAUGAAAGCACUGCUA-3'   (SEQ ID NO: 5031)
                 3'-CUUAAGGACACGUACUUUCGUGACGAU-5'   (SEQ ID NO: 2130)

AR-3551 Target:  5'-GAATTCCTGTGCATGAAAGCACTGCTA-3'   (SEQ ID NO: 2535)

5'-AAUUCCUGUGCAUGAAAGCACUGCUAC-3'   (SEQ ID NO: 5032)
                 3'-UUAAGGACACGUACUUUCGUGACGAUG-5'   (SEQ ID NO: 2131)

AR-3552 Target:  5'-AATTCCTGTGCATGAAAGCACTGCTAC-3'   (SEQ ID NO: 2536)

5'-AUUCCUGUGCAUGAAAGCACUGCUACU-3'   (SEQ ID NO: 5033)
                 3'-UAAGGACACGUACUUUCGUGACGAUGA-5'   (SEQ ID NO: 2132)

AR-3553 Target:  5'-ATTCCTGTGCATGAAAGCACTGCTACT-3'   (SEQ ID NO: 2537)

5'-UUCCUGUGCAUGAAAGCACUGCUACUC-3'   (SEQ ID NO: 5034)
                 3'-AAGGACACGUACUUUCGUGACGAUGAG-5'   (SEQ ID NO: 2133)

AR-3554 Target:  5'-TTCCTGTGCATGAAAGCACTGCTACTC-3'   (SEQ ID NO: 2538)

5'-UCCUGUGCAUGAAAGCACUGCUACUCU-3'   (SEQ ID NO: 5035)
                 3'-AGGACACGUACUUUCGUGACGAUGAGA-5'   (SEQ ID NO: 2134)

AR-3555 Target:  5'-TCCTGTGCATGAAAGCACTGCTACTCT-3'   (SEQ ID NO: 2539)

5'-CCUGUGCAUGAAAGCACUGCUACUCUU-3'   (SEQ ID NO: 5036)
                 3'-GGACACGUACUUUCGUGACGAUGAGAA-5'   (SEQ ID NO: 2135)

AR-3556 Target:  5'-CCTGTGCATGAAAGCACTGCTACTCTT-3'   (SEQ ID NO: 2540)

5'-UACUCUUCAGCAUUAUUCCAGUGGAUG-3'   (SEQ ID NO: 5037)
                 3'-AUGAGAAGUCGUAAUAAGGUCACCUAC-5'   (SEQ ID NO: 2136)

AR-3576 Target:  5'-TACTCTTCAGCATTATTCCAGTGGATG-3'   (SEQ ID NO: 2541)

5'-ACUCUUCAGCAUUAUUCCAGUGGAUGG-3'   (SEQ ID NO: 5038)
                 3'-UGAGAAGUCGUAAUAAGGUCACCUACC-5'   (SEQ ID NO: 2137)
```

TABLE 7-continued

Selected Human Anti-AR 27mer "Blunt/Blunt" DsiRNA Agents

```
AR-3577 Target:  5'-ACTCTTCAGCATTATTCCAGTGGATGG-3'    (SEQ ID NO: 2542)

5'-CUCUUCAGCAUUAUUCCAGUGGAUGGG-3'    (SEQ ID NO: 5039)
                 3'-GAGAAGUCGUAAUAAGGUCACCUACCC-5'    (SEQ ID NO: 2138)

AR-3578 Target:  5'-CTCTTCAGCATTATTCCAGTGGATGGG-3'    (SEQ ID NO: 2543)

5'-UCUUCAGCAUUAUUCCAGUGGAUGGGC-3'   (SEQ ID NO: 5040)
                 3'-AGAAGUCGUAAUAAGGUCACCUACCCG-5'   (SEQ ID NO: 2139)

AR-3579 Target:  5'-TCTTCAGCATTATTCCAGTGGATGGGC-3'    (SEQ ID NO: 2544)

5'-CUUCAGCAUUAUUCCAGUGGAUGGGCU-3'   (SEQ ID NO: 5041)
                 3'-GAAGUCGUAAUAAGGUCACCUACCCGA-5'   (SEQ ID NO: 2140)

AR-3580 Target:  5'-CTTCAGCATTATTCCAGTGGATGGGCT-3'    (SEQ ID NO: 2545)

5'-UUCAGCAUUAUUCCAGUGGAUGGGCUG-3'   (SEQ ID NO: 5042)
                 3'-AAGUCGUAAUAAGGUCACCUACCCGAC-5'   (SEQ ID NO: 2141)

AR-3581 Target:  5'-TTCAGCATTATTCCAGTGGATGGGCTG-3'    (SEQ ID NO: 2546)

5'-UCAGCAUUAUUCCAGUGGAUGGGCUGA-3'   (SEQ ID NO: 5043)
                 3'-AGUCGUAAUAAGGUCACCUACCCGACU-5'   (SEQ ID NO: 2142)

AR-3582 Target:  5'-TCAGCATTATTCCAGTGGATGGGCTGA-3'    (SEQ ID NO: 2547)

5'-CAGCAUUAUUCCAGUGGAUGGGCUGAA-3'   (SEQ ID NO: 5044)
                 3'-GUCGUAAUAAGGUCACCUACCCGACUU-5'   (SEQ ID NO: 2143)

AR-3583 Target:  5'-CAGCATTATTCCAGTGGATGGGCTGAA-3'    (SEQ ID NO: 2548)

5'-AGCAUUAUUCCAGUGGAUGGGCUGAAA-3'   (SEQ ID NO: 5045)
                 3'-UCGUAAUAAGGUCACCUACCCGACUUU-5'   (SEQ ID NO: 2144)

AR-3584 Target:  5'-AGCATTATTCCAGTGGATGGGCTGAAA-3'    (SEQ ID NO: 2549)

5'-GCAUUAUUCCAGUGGAUGGGCUGAAAA-3'   (SEQ ID NO: 5046)
                 3'-CGUAAUAAGGUCACCUACCCGACUUUU-5'   (SEQ ID NO: 2145)

AR-3585 Target:  5'-GCATTATTCCAGTGGATGGGCTGAAAA-3'    (SEQ ID NO: 2550)

5'-CAUUAUUCCAGUGGAUGGGCUGAAAAA-3'   (SEQ ID NO: 5047)
                 3'-GUAAUAAGGUCACCUACCCGACUUUUU-5'   (SEQ ID NO: 2146)

AR-3586 Target:  5'-CATTATTCCAGTGGATGGGCTGAAAAA-3'    (SEQ ID NO: 2551)

5'-AUUAUUCCAGUGGAUGGGCUGAAAAAU-3'   (SEQ ID NO: 5048)
                 3'-UAAUAAGGUCACCUACCCGACUUUUUA-5'   (SEQ ID NO: 2147)

AR-3587 Target:  5'-ATTATTCCAGTGGATGGGCTGAAAAAT-3'    (SEQ ID NO: 2552)

5'-UUAUUCCAGUGGAUGGGCUGAAAAAUC-3'   (SEQ ID NO: 5049)
                 3'-AAUAAGGUCACCUACCCGACUUUUUAG-5'   (SEQ ID NO: 2148)

AR-3588 Target:  5'-TTATTCCAGTGGATGGGCTGAAAAATC-3'    (SEQ ID NO: 2553)

5'-UAUUCCAGUGGAUGGGCUGAAAAAUCA-3'   (SEQ ID NO: 5050)
                 3'-AUAAGGUCACCUACCCGACUUUUUAGU-5'   (SEQ ID NO: 2149)

AR-3589 Target:  5'-TATTCCAGTGGATGGGCTGAAAAATCA-3'    (SEQ ID NO: 2554)

5'-AUUCCAGUGGAUGGGCUGAAAAAUCAA-3'   (SEQ ID NO: 5051)
                 3'-UAAGGUCACCUACCCGACUUUUUAGUU-5'   (SEQ ID NO: 2150)

AR-3590 Target:  5'-ATTCCAGTGGATGGGCTGAAAAATCAA-3'    (SEQ ID NO: 2555)

5'-UUCCAGUGGAUGGGCUGAAAAAUCAAA-3'   (SEQ ID NO: 5052)
                 3'-AAGGUCACCUACCCGACUUUUUAGUUU-5'   (SEQ ID NO: 2151)

AR-3591 Target:  5'-TTCCAGTGGATGGGCTGAAAAATCAAA-3'    (SEQ ID NO: 2556)

5'-UCCAGUGGAUGGGCUGAAAAAUCAAAA-3'   (SEQ ID NO: 5053)
                 3'-AGGUCACCUACCCGACUUUUUAGUUUU-5'   (SEQ ID NO: 2152)
```

TABLE 7-continued

Selected Human Anti-AR 27mer "Blunt/Blunt" DsiRNA Agents

```
AR-3592 Target:  5'-TCCAGTGGATGGGCTGAAAAATCAAAA-3'   (SEQ ID NO: 2557)

5'-CCAGUGGAUGGGCUGAAAAAUCAAAAA-3'  (SEQ ID NO: 5054)
                 3'-GGUCACCUACCCGACUUUUUAGUUUUU-5'  (SEQ ID NO: 2153)

AR-3593 Target:  5'-CCAGTGGATGGGCTGAAAAATCAAAAA-3'  (SEQ ID NO: 2558)

5'-CAGUGGAUGGGCUGAAAAAUCAAAAAU-3'  (SEQ ID NO: 5055)
                 3'-GUCACCUACCCGACUUUUUAGUUUUUA-5'  (SEQ ID NO: 2154)

AR-3594 Target:  5'-CAGTGGATGGGCTGAAAAATCAAAAAT-3'  (SEQ ID NO: 2559)

5'-AGUGGAUGGGCUGAAAAAUCAAAAAUU-3'  (SEQ ID NO: 5056)
                 3'-UCACCUACCCGACUUUUUAGUUUUUAA-5'  (SEQ ID NO: 2155)

AR-3595 Target:  5'-AGTGGATGGGCTGAAAAATCAAAAATT-3'  (SEQ ID NO: 2560)

5'-GUGGAUGGGCUGAAAAAUCAAAAAUUC-3'  (SEQ ID NO: 5057)
                 3'-CACCUACCCGACUUUUUAGUUUUUAAG-5'  (SEQ ID NO: 2156)

AR-3596 Target:  5'-GTGGATGGGCTGAAAAATCAAAAATTC-3'  (SEQ ID NO: 2561)

5'-UGGAUGGGCUGAAAAAUCAAAAAUUCU-3'  (SEQ ID NO: 5058)
                 3'-ACCUACCCGACUUUUUAGUUUUUAAGA-5'  (SEQ ID NO: 2157)

AR-3597 Target:  5'-TGGATGGGCTGAAAAATCAAAAATTCT-3'  (SEQ ID NO: 2562)

5'-GGAUGGGCUGAAAAAUCAAAAAUUCUU-3'  (SEQ ID NO: 5059)
                 3'-CCUACCCGACUUUUUAGUUUUUAAGAA-5'  (SEQ ID NO: 2158)

AR-3598 Target:  5'-GGATGGGCTGAAAAATCAAAAATTCTT-3'  (SEQ ID NO: 2563)

5'-GAUGGGCUGAAAAAUCAAAAAUUCUUU-3'  (SEQ ID NO: 5060)
                 3'-CUACCCGACUUUUUAGUUUUUAAGAAA-5'  (SEQ ID NO: 2159)

AR-3599 Target:  5'-GATGGGCTGAAAAATCAAAAATTCTTT-3'  (SEQ ID NO: 2564)

5'-AUGGGCUGAAAAAUCAAAAAUUCUUUG-3'  (SEQ ID NO: 5061)
                 3'-UACCCGACUUUUUAGUUUUUAAGAAAC-5'  (SEQ ID NO: 2160)

AR-3600 Target:  5'-ATGGGCTGAAAAATCAAAAATTCTTTG-3'  (SEQ ID NO: 2565)

5'-UGGGCUGAAAAAUCAAAAAUUCUUUGA-3'  (SEQ ID NO: 5062)
                 3'-ACCCGACUUUUUAGUUUUUAAGAAACU-5'  (SEQ ID NO: 2161)

AR-3601 Target:  5'-TGGGCTGAAAAATCAAAAATTCTTTGA-3'  (SEQ ID NO: 2566)

5'-GGGCUGAAAAAUCAAAAAUUCUUUGAU-3'  (SEQ ID NO: 5063)
                 3'-CCCGACUUUUUAGUUUUUAAGAAACUA-5'  (SEQ ID NO: 2162)

AR-3602 Target:  5'-GGGCTGAAAAATCAAAAATTCTTTGAT-3'  (SEQ ID NO: 2567)

5'-GGCUGAAAAAUCAAAAAUUCUUUGAUG-3'  (SEQ ID NO: 5064)
                 3'-CCGACUUUUUAGUUUUUAAGAAACUAC-5'  (SEQ ID NO: 2163)

AR-3603 Target:  5'-GGCTGAAAAATCAAAAATTCTTTGATG-3'  (SEQ ID NO: 2568)

5'-GCUGAAAAAUCAAAAAUUCUUUGAUGA-3'  (SEQ ID NO: 5065)
                 3'-CGACUUUUUAGUUUUUAAGAAACUACU-5'  (SEQ ID NO: 2164)

AR-3604 Target:  5'-GCTGAAAAATCAAAAATTCTTTGATGA-3'  (SEQ ID NO: 2569)

5'-CUGAAAAAUCAAAAAUUCUUUGAUGAA-3'  (SEQ ID NO: 5066)
                 3'-GACUUUUUAGUUUUUAAGAAACUACUU-5'  (SEQ ID NO: 2165)

AR-3605 Target:  5'-CTGAAAAATCAAAAATTCTTTGATGAA-3'  (SEQ ID NO: 2570)

5'-UGAAAAAUCAAAAAUUCUUUGAUGAAC-3'  (SEQ ID NO: 5067)
                 3'-ACUUUUUAGUUUUUAAGAAACUACUUG-5'  (SEQ ID NO: 2166)

AR-3606 Target:  5'-TGAAAAATCAAAAATTCTTTGATGAAC-3'  (SEQ ID NO: 2571)

5'-AAAAAUCAAAAAUUCUUUGAUGAACUU-3'  (SEQ ID NO: 5068)
                 3'-UUUUUAGUUUUUAAGAAACUACUUGAA-5'  (SEQ ID NO: 2167)
```

TABLE 7-continued

Selected Human Anti-AR 27mer "Blunt/Blunt" DsiRNA Agents

```
AR-3608 Target:  5'-AAAAATCAAAAATTCTTTGATGAACTT-3'   (SEQ ID NO: 2572)

5'-AAAAUCAAAAAUUCUUUGAUGAACUUC-3'  (SEQ ID NO: 5069)
                 3'-UUUUAGUUUUUAAGAAACUACUUGAAG-5'  (SEQ ID NO: 2168)

AR-3609 Target:  5'-AAAATCAAAAATTCTTTGATGAACTTC-3'  (SEQ ID NO: 2573)

5'-AAAUCAAAAAUUCUUUGAUGAACUUCG-3'  (SEQ ID NO: 5070)
                 3'-UUUAGUUUUUAAGAAACUACUUGAAGC-5'  (SEQ ID NO: 2169)

AR-3610 Target:  5'-AAATCAAAAATTCTTTGATGAACTTCG-3'  (SEQ ID NO: 2574)

5'-AAUCAAAAAUUCUUUGAUGAACUUCGA-3'  (SEQ ID NO: 5071)
                 3'-UUAGUUUUUAAGAAACUACUUGAAGCU-5'  (SEQ ID NO: 2170)

AR-3611 Target:  5'-AATCAAAAATTCTTTGATGAACTTCGA-3'  (SEQ ID NO: 2575)

5'-AUCAAAAAUUCUUUGAUGAACUUCGAA-3'  (SEQ ID NO: 5072)
                 3'-UAGUUUUUAAGAAACUACUUGAAGCUU-5'  (SEQ ID NO: 2171)

AR-3612 Target:  5'-ATCAAAAATTCTTTGATGAACTTCGAA-3'  (SEQ ID NO: 2576)

5'-UCAAAAAUUCUUUGAUGAACUUCGAAU-3'  (SEQ ID NO: 5073)
                 3'-AGUUUUUAAGAAACUACUUGAAGCUUA-5'  (SEQ ID NO: 2172)

AR-3613 Target:  5'-TCAAAAATTCTTTGATGAACTTCGAAT-3'  (SEQ ID NO: 2577)

5'-CAAAAAUUCUUUGAUGAACUUCGAAUG-3'  (SEQ ID NO: 5074)
                 3'-GUUUUUAAGAAACUACUUGAAGCUUAC-5'  (SEQ ID NO: 2173)

AR-3614 Target:  5'-CAAAAATTCTTTGATGAACTTCGAATG-3'  (SEQ ID NO: 2578)

5'-AAAAAUUCUUUGAUGAACUUCGAAUGA-3'  (SEQ ID NO: 5075)
                 3'-UUUUUAAGAAACUACUUGAAGCUUACU-5'  (SEQ ID NO: 2174)

AR-3615 Target:  5'-AAAAATTCTTTGATGAACTTCGAATGA-3'  (SEQ ID NO: 2579)

5'-AAAAUUCUUUGAUGAACUUCGAAUGAA-3'  (SEQ ID NO: 5076)
                 3'-UUUUAAGAAACUACUUGAAGCUUACUU-5'  (SEQ ID NO: 2175)

AR-3616 Target:  5'-AAAATTCTTTGATGAACTTCGAATGAA-3'  (SEQ ID NO: 2580)

5'-AAAUUCUUUGAUGAACUUCGAAUGAAC-3'  (SEQ ID NO: 5077)
                 3'-UUUAAGAAACUACUUGAAGCUUACUUG-5'  (SEQ ID NO: 2176)

AR-3617 Target:  5'-AAATTCTTTGATGAACTTCGAATGAAC-3'  (SEQ ID NO: 2581)

5'-AAUUCUUUGAUGAACUUCGAAUGAACU-3'  (SEQ ID NO: 5078)
                 3'-UUAAGAAACUACUUGAAGCUUACUUGA-5'  (SEQ ID NO: 2177)

AR-3618 Target:  5'-AATTCTTTGATGAACTTCGAATGAACT-3'  (SEQ ID NO: 2582)

5'-AUUCUUUGAUGAACUUCGAAUGAACUA-3'  (SEQ ID NO: 5079)
                 3'-UAAGAAACUACUUGAAGCUUACUUGAU-5'  (SEQ ID NO: 2178)

AR-3619 Target:  5'-ATTCTTTGATGAACTTCGAATGAACTA-3'  (SEQ ID NO: 2583)

5'-UUCUUUGAUGAACUUCGAAUGAACUAC-3'  (SEQ ID NO: 5080)
                 3'-AAGAAACUACUUGAAGCUUACUUGAUG-5'  (SEQ ID NO: 2179)

AR-3620 Target:  5'-TTCTTTGATGAACTTCGAATGAACTAC-3'  (SEQ ID NO: 2584)

5'-UCUUUGAUGAACUUCGAAUGAACUACA-3'  (SEQ ID NO: 5081)
                 3'-AGAAACUACUUGAAGCUUACUUGAUGU-5'  (SEQ ID NO: 2180)

AR-3621 Target:  5'-TCTTTGATGAACTTCGAATGAACTACA-3'  (SEQ ID NO: 2585)

5'-CUUUGAUGAACUUCGAAUGAACUACAU-3'  (SEQ ID NO: 5082)
                 3'-GAAACUACUUGAAGCUUACUUGAUGUA-5'  (SEQ ID NO: 2181)

AR-3622 Target:  5'-CTTTGATGAACTTCGAATGAACTACAT-3'  (SEQ ID NO: 2586)

5'-UUUGAUGAACUUCGAAUGAACUACAUC-3'  (SEQ ID NO: 5083)
                 3'-AAACUACUUGAAGCUUACUUGAUGUAG-5'  (SEQ ID NO: 2182)
```

TABLE 7-continued

Selected Human Anti-AR 27mer "Blunt/Blunt" DsiRNA Agents

```
AR-3623 Target:  5'-TTTGATGAACTTCGAATGAACTACATC-3'   (SEQ ID NO: 2587)

5'-UUGAUGAACUUCGAAUGAACUACAUCA-3'   (SEQ ID NO: 5084)
                 3'-AACUACUUGAAGCUUACUUGAUGUAGU-5'   (SEQ ID NO: 2183)

AR-3624 Target:  5'-TTGATGAACTTCGAATGAACTACATCA-3'   (SEQ ID NO: 2588)

5'-UGAUGAACUUCGAAUGAACUACAUCAA-3'  (SEQ ID NO: 5085)
                 3'-ACUACUUGAAGCUUACUUGAUGUAGUU-5'  (SEQ ID NO: 2184)

AR-3625 Target:  5'-TGATGAACTTCGAATGAACTACATCAA-3'  (SEQ ID NO: 2589)

5'-GAUGAACUUCGAAUGAACUACAUCAAG-3'  (SEQ ID NO: 5086)
                 3'-CUACUUGAAGCUUACUUGAUGUAGUUC-5'  (SEQ ID NO: 2185)

AR-3626 Target:  5'-GATGAACTTCGAATGAACTACATCAAG-3'  (SEQ ID NO: 2590)

5'-AUGAACUUCGAAUGAACUACAUCAAGG-3'  (SEQ ID NO: 5087)
                 3'-UACUUGAAGCUUACUUGAUGUAGUUCC-5'  (SEQ ID NO: 2186)

AR-3627 Target:  5'-ATGAACTTCGAATGAACTACATCAAGG-3'  (SEQ ID NO: 2591)

5'-UGAACUUCGAAUGAACUACAUCAAGGA-3'  (SEQ ID NO: 5088)
                 3'-ACUUGAAGCUUACUUGAUGUAGUUCCU-5'  (SEQ ID NO: 2187)

AR-3628 Target:  5'-TGAACTTCGAATGAACTACATCAAGGA-3'  (SEQ ID NO: 2592)

5'-GAACUUCGAAUGAACUACAUCAAGGAA-3'  (SEQ ID NO: 5089)
                 3'-CUUGAAGCUUACUUGAUGUAGUUCCUU-5'  (SEQ ID NO: 2188)

AR-3629 Target:  5'-GAACTTCGAATGAACTACATCAAGGAA-3'  (SEQ ID NO: 2593)

5'-AACUUCGAAUGAACUACAUCAAGGAAC-3'  (SEQ ID NO: 5090)
                 3'-UUGAAGCUUACUUGAUGUAGUUCCUUG-5'  (SEQ ID NO: 2189)

AR-3630 Target:  5'-AACTTCGAATGAACTACATCAAGGAAC-3'  (SEQ ID NO: 2594)

5'-ACUUCGAAUGAACUACAUCAAGGAACU-3'  (SEQ ID NO: 5091)
                 3'-UGAAGCUUACUUGAUGUAGUUCCUUGA-5'  (SEQ ID NO: 2190)

AR-3631 Target:  5'-ACTTCGAATGAACTACATCAAGGAACT-3'  (SEQ ID NO: 2595)

5'-CUUCGAAUGAACUACAUCAAGGAACUC-3'  (SEQ ID NO: 5092)
                 3'-GAAGCUUACUUGAUGUAGUUCCUUGAG-5'  (SEQ ID NO: 2191)

AR-3632 Target:  5'-CTTCGAATGAACTACATCAAGGAACTC-3'  (SEQ ID NO: 2596)

5'-UUCGAAUGAACUACAUCAAGGAACUCG-3'  (SEQ ID NO: 5093)
                 3'-AAGCUUACUUGAUGUAGUUCCUUGAGC-5'  (SEQ ID NO: 2192)

AR-3633 Target:  5'-TTCGAATGAACTACATCAAGGAACTCG-3'  (SEQ ID NO: 2597)

5'-UCGAAUGAACUACAUCAAGGAACUCGA-3'  (SEQ ID NO: 5094)
                 3'-AGCUUACUUGAUGUAGUUCCUUGAGCU-5'  (SEQ ID NO: 2193)

AR-3634 Target:  5'-TCGAATGAACTACATCAAGGAACTCGA-3'  (SEQ ID NO: 2598)

5'-CGAAUGAACUACAUCAAGGAACUCGAU-3'  (SEQ ID NO: 5095)
                 3'-GCUUACUUGAUGUAGUUCCUUGAGCUA-5'  (SEQ ID NO: 2194)

AR-3635 Target:  5'-CGAATGAACTACATCAAGGAACTCGAT-3'  (SEQ ID NO: 2599)

5'-GAAUGAACUACAUCAAGGAACUCGAUC-3'  (SEQ ID NO: 5096)
                 3'-CUUACUUGAUGUAGUUCCUUGAGCUAG-5'  (SEQ ID NO: 2195)

AR-3636 Target:  5'-GAATGAACTACATCAAGGAACTCGATC-3'  (SEQ ID NO: 2600)

5'-AAUGAACUACAUCAAGGAACUCGAUCG-3'  (SEQ ID NO: 5097)
                 3'-UUACUUGAUGUAGUUCCUUGAGCUAGC-5'  (SEQ ID NO: 2196)

AR-3637 Target:  5'-AATGAACTACATCAAGGAACTCGATCG-3'  (SEQ ID NO: 2601)

5'-AUGAACUACAUCAAGGAACUCGAUCGU-3'  (SEQ ID NO: 5098)
                 3'-UACUUGAUGUAGUUCCUUGAGCUAGCA-5'  (SEQ ID NO: 2197)
```

TABLE 7-continued

Selected Human Anti-AR 27mer "Blunt/Blunt" DsiRNA Agents

```
AR-3638 Target:  5'-ATGAACTACATCAAGGAACTCGATCGT-3'    (SEQ ID NO: 2602)

5'-UGAACUACAUCAAGGAACUCGAUCGUA-3'   (SEQ ID NO: 5099)
                 3'-ACUUGAUGUAGUUCCUUGAGCUAGCAU-5'   (SEQ ID NO: 2198)

AR-3639 Target:  5'-TGAACTACATCAAGGAACTCGATCGTA-3'    (SEQ ID NO: 2603)

5'-GAACUACAUCAAGGAACUCGAUCGUAU-3'   (SEQ ID NO: 5100)
                 3'-CUUGAUGUAGUUCCUUGAGCUAGCAUA-5'   (SEQ ID NO: 2199)

AR-3640 Target:  5'-GAACTACATCAAGGAACTCGATCGTAT-3'    (SEQ ID NO: 2604)

5'-AACUACAUCAAGGAACUCGAUCGUAUC-3'   (SEQ ID NO: 5101)
                 3'-UUGAUGUAGUUCCUUGAGCUAGCAUAG-5'   (SEQ ID NO: 2200)

AR-3641 Target:  5'-AACTACATCAAGGAACTCGATCGTATC-3'    (SEQ ID NO: 2605)

5'-ACUACAUCAAGGAACUCGAUCGUAUCA-3'   (SEQ ID NO: 5102)
                 3'-UGAUGUAGUUCCUUGAGCUAGCAUAGU-5'   (SEQ ID NO: 2201)

AR-3642 Target:  5'-ACTACATCAAGGAACTCGATCGTATCA-3'    (SEQ ID NO: 2606)

5'-CUACAUCAAGGAACUCGAUCGUAUCAU-3'   (SEQ ID NO: 5103)
                 3'-GAUGUAGUUCCUUGAGCUAGCAUAGUA-5'   (SEQ ID NO: 2202)

AR-3643 Target:  5'-CTACATCAAGGAACTCGATCGTATCAT-3'    (SEQ ID NO: 2607)

5'-GUAUCAUUGCAUGCAAAAGAAAAAAUC-3'   (SEQ ID NO: 5104)
                 3'-CAUAGUAACGUACGUUUUCUUUUUUAG-5'   (SEQ ID NO: 2203)

AR-3663 Target:  5'-GTATCATTGCATGCAAAAGAAAAAATC-3'    (SEQ ID NO: 2608)

5'-UAUCAUUGCAUGCAAAAGAAAAAAUCC-3'   (SEQ ID NO: 5105)
                 3'-AUAGUAACGUACGUUUUCUUUUUUAGG-5'   (SEQ ID NO: 2204)

AR-3664 Target:  5'-TATCATTGCATGCAAAAGAAAAAATCC-3'    (SEQ ID NO: 2609)

5'-AAAAUCCCACAUCCUGCUCAAGACGCU-3'   (SEQ ID NO: 5106)
                 3'-UUUUAGGGUGUAGGACGAGUUCUGCGA-5'   (SEQ ID NO: 2205)

AR-3684 Target:  5'-AAAATCCCACATCCTGCTCAAGACGCT-3'    (SEQ ID NO: 2610)

5'-AAAUCCCACAUCCUGCUCAAGACGCUU-3'   (SEQ ID NO: 5107)
                 3'-UUUAGGGUGUAGGACGAGUUCUGCGAA-5'   (SEQ ID NO: 2206)

AR-3685 Target:  5'-AAATCCCACATCCTGCTCAAGACGCTT-3'    (SEQ ID NO: 2611)

5'-GACGCUUCUACCAGCUCACCAAGCUCC-3'   (SEQ ID NO: 5108)
                 3'-CUGCGAAGAUGGUCGAGUGGUUCGAGG-5'   (SEQ ID NO: 2207)

AR-3705 Target:  5'-GACGCTTCTACCAGCTCACCAAGCTCC-3'    (SEQ ID NO: 2612)

5'-ACGCUUCUACCAGCUCACCAAGCUCCU-3'   (SEQ ID NO: 5109)
                 3'-UGCGAAGAUGGUCGAGUGGUUCGAGGA-5'   (SEQ ID NO: 2208)

AR-3706 Target:  5'-ACGCTTCTACCAGCTCACCAAGCTCCT-3'    (SEQ ID NO: 2613)

5'-CGCUUCUACCAGCUCACCAAGCUCCUG-3'   (SEQ ID NO: 5110)
                 3'-GCGAAGAUGGUCGAGUGGUUCGAGGAC-5'   (SEQ ID NO: 2209)

AR-3707 Target:  5'-CGCTTCTACCAGCTCACCAAGCTCCTG-3'    (SEQ ID NO: 2614)

5'-GCUUCUACCAGCUCACCAAGCUCCUGG-3'   (SEQ ID NO: 5111)
                 3'-CGAAGAUGGUCGAGUGGUUCGAGGACC-5'   (SEQ ID NO: 2210)

AR-3708 Target:  5'-GCTTCTACCAGCTCACCAAGCTCCTGG-3'    (SEQ ID NO: 2615)

5'-CUUCUACCAGCUCACCAAGCUCCUGGA-3'   (SEQ ID NO: 5112)
                 3'-GAAGAUGGUCGAGUGGUUCGAGGACCU-5'   (SEQ ID NO: 2211)

AR-3709 Target:  5'-CTTCTACCAGCTCACCAAGCTCCTGGA-3'    (SEQ ID NO: 2616)

5'-UUCUACCAGCUCACCAAGCUCCUGGAC-3'   (SEQ ID NO: 5113)
                 3'-AAGAUGGUCGAGUGGUUCGAGGACCUG-5'   (SEQ ID NO: 2212)
```

TABLE 7-continued

Selected Human Anti-AR 27mer "Blunt/Blunt" DsiRNA Agents

```
AR-3710 Target:  5'-TTCTACCAGCTCACCAAGCTCCTGGAC-3'   (SEQ ID NO: 2617)

5'-UCUACCAGCUCACCAAGCUCCUGGACU-3'  (SEQ ID NO: 5114)
                 3'-AGAUGGUCGAGUGGUUCGAGGACCUGA-5'  (SEQ ID NO: 2213)

AR-3711 Target:  5'-TCTACCAGCTCACCAAGCTCCTGGACT-3'   (SEQ ID NO: 2618)

5'-CUACCAGCUCACCAAGCUCCUGGACUC-3'  (SEQ ID NO: 5115)
                 3'-GAUGGUCGAGUGGUUCGAGGACCUGAG-5'  (SEQ ID NO: 2214)

AR-3712 Target:  5'-CTACCAGCTCACCAAGCTCCTGGACTC-3'   (SEQ ID NO: 2619)

5'-UACCAGCUCACCAAGCUCCUGGACUCC-3'  (SEQ ID NO: 5116)
                 3'-AUGGUCGAGUGGUUCGAGGACCUGAGG-5'  (SEQ ID NO: 2215)

AR-3713 Target:  5'-TACCAGCTCACCAAGCTCCTGGACTCC-3'   (SEQ ID NO: 2620)

5'-ACCAGCUCACCAAGCUCCUGGACUCCG-3'  (SEQ ID NO: 5117)
                 3'-UGGUCGAGUGGUUCGAGGACCUGAGGC-5'  (SEQ ID NO: 2216)

AR-3714 Target:  5'-ACCAGCTCACCAAGCTCCTGGACTCCG-3'   (SEQ ID NO: 2621)

5'-CCAGCUCACCAAGCUCCUGGACUCCGU-3'  (SEQ ID NO: 5118)
                 3'-GGUCGAGUGGUUCGAGGACCUGAGGCA-5'  (SEQ ID NO: 2217)

AR-3715 Target:  5'-CCAGCTCACCAAGCTCCTGGACTCCGT-3'   (SEQ ID NO: 2622)

5'-AGCUCACCAAGCUCCUGGACUCCGUGC-3'  (SEQ ID NO: 5119)
                 3'-UCGAGUGGUUCGAGGACCUGAGGCACG-5'  (SEQ ID NO: 2218)

AR-3717 Target:  5'-AGCTCACCAAGCTCCTGGACTCCGTGC-3'   (SEQ ID NO: 2623)

5'-AGCUCCUGGACUCCGUGCAGCCUAUUG-3'  (SEQ ID NO: 5120)
                 3'-UCGAGGACCUGAGGCACGUCGGAUAAC-5'  (SEQ ID NO: 2219)

AR-3726 Target:  5'-AGCTCCTGGACTCCGTGCAGCCTATTG-3'   (SEQ ID NO: 2624)

5'-UCCGUGCAGCCUAUUGCGAGAGAGCUG-3'  (SEQ ID NO: 5121)
                 3'-AGGCACGUCGGAUAACGCUCUCUCGAC-5'  (SEQ ID NO: 2220)

AR-3737 Target:  5'-TCCGTGCAGCCTATTGCGAGAGAGCTG-3'   (SEQ ID NO: 2625)

5'-CGAGAGAGCUGCAUCAGUUCACUUUUG-3'  (SEQ ID NO: 5122)
                 3'-GCUCUCUCGACGUAGUCAAGUGAAAAC-5'  (SEQ ID NO: 2221)

AR-3753 Target:  5'-CGAGAGAGCTGCATCAGTTCACTTTTG-3'   (SEQ ID NO: 2626)

5'-GAGAGAGCUGCAUCAGUUCACUUUUGA-3'  (SEQ ID NO: 5123)
                 3'-CUCUCUCGACGUAGUCAAGUGAAAACU-5'  (SEQ ID NO: 2222)

AR-3754 Target:  5'-GAGAGAGCTGCATCAGTTCACTTTTGA-3'   (SEQ ID NO: 2627)

5'-AGAGAGCUGCAUCAGUUCACUUUUGAC-3'  (SEQ ID NO: 5124)
                 3'-UCUCUCGACGUAGUCAAGUGAAAACUG-5'  (SEQ ID NO: 2223)

AR-3755 Target:  5'-AGAGAGCTGCATCAGTTCACTTTTGAC-3'   (SEQ ID NO: 2628)

5'-GAGAGCUGCAUCAGUUCACUUUUGACC-3'  (SEQ ID NO: 5125)
                 3'-CUCUCGACGUAGUCAAGUGAAAACUGG-5'  (SEQ ID NO: 2224)

AR-3756 Target:  5'-GAGAGCTGCATCAGTTCACTTTTGACC-3'   (SEQ ID NO: 2629)

5'-AGAGCUGCAUCAGUUCACUUUUGACCU-3'  (SEQ ID NO: 5126)
                 3'-UCUCGACGUAGUCAAGUGAAAACUGGA-5'  (SEQ ID NO: 2225)

AR-3757 Target:  5'-AGAGCTGCATCAGTTCACTTTTGACCT-3'   (SEQ ID NO: 2630)

5'-GAGCUGCAUCAGUUCACUUUUGACCUG-3'  (SEQ ID NO: 5127)
                 3'-CUCGACGUAGUCAAGUGAAAACUGGAC-5'  (SEQ ID NO: 2226)

AR-3758 Target:  5'-GAGCTGCATCAGTTCACTTTTGACCTG-3'   (SEQ ID NO: 2631)

5'-AGCUGCAUCAGUUCACUUUUGACCUGC-3'  (SEQ ID NO: 5128)
                 3'-UCGACGUAGUCAAGUGAAAACUGGACG-5'  (SEQ ID NO: 2227)
```

TABLE 7-continued

Selected Human Anti-AR 27mer "Blunt/Blunt" DsiRNA Agents

```
AR-3759 Target:  5'-AGCTGCATCAGTTCACTTTTGACCTGC-3'    (SEQ ID NO: 2632)

5'-GCUGCAUCAGUUCACUUUUGACCUGCU-3'   (SEQ ID NO: 5129)
                 3'-CGACGUAGUCAAGUGAAAACUGGACGA-5'   (SEQ ID NO: 2228)

AR-3760 Target:  5'-GCTGCATCAGTTCACTTTTGACCTGCT-3'    (SEQ ID NO: 2633)

5'-CUGCAUCAGUUCACUUUUGACCUGCUA-3'   (SEQ ID NO: 5130)
                 3'-GACGUAGUCAAGUGAAAACUGGACGAU-5'   (SEQ ID NO: 2229)

AR-3761 Target:  5'-CTGCATCAGTTCACTTTTGACCTGCTA-3'    (SEQ ID NO: 2634)

5'-UGCAUCAGUUCACUUUUGACCUGCUAA-3'   (SEQ ID NO: 5131)
                 3'-ACGUAGUCAAGUGAAAACUGGACGAUU-5'   (SEQ ID NO: 2230)

AR-3762 Target:  5'-TGCATCAGTTCACTTTTGACCTGCTAA-3'    (SEQ ID NO: 2635)

5'-GCAUCAGUUCACUUUUGACCUGCUAAU-3'   (SEQ ID NO: 5132)
                 3'-CGUAGUCAAGUGAAAACUGGACGAUUA-5'   (SEQ ID NO: 2231)

AR-3763 Target:  5'-GCATCAGTTCACTTTTGACCTGCTAAT-3'    (SEQ ID NO: 2636)

5'-CAUCAGUUCACUUUUGACCUGCUAAUC-3'   (SEQ ID NO: 5133)
                 3'-GUAGUCAAGUGAAAACUGGACGAUUAG-5'   (SEQ ID NO: 2232)

AR-3764 Target:  5'-CATCAGTTCACTTTTGACCTGCTAATC-3'    (SEQ ID NO: 2637)

5'-AUCAGUUCACUUUUGACCUGCUAAUCA-3'   (SEQ ID NO: 5134)
                 3'-UAGUCAAGUGAAAACUGGACGAUUAGU-5'   (SEQ ID NO: 2233)

AR-3765 Target:  5'-ATCAGTTCACTTTTGACCTGCTAATCA-3'    (SEQ ID NO: 2638)

5'-UCAGUUCACUUUUGACCUGCUAAUCAA-3'   (SEQ ID NO: 5135)
                 3'-AGUCAAGUGAAAACUGGACGAUUAGUU-5'   (SEQ ID NO: 2234)

AR-3766 Target:  5'-TCAGTTCACTTTTGACCTGCTAATCAA-3'    (SEQ ID NO: 2639)

5'-CAGUUCACUUUUGACCUGCUAAUCAAG-3'   (SEQ ID NO: 5136)
                 3'-GUCAAGUGAAAACUGGACGAUUAGUUC-5'   (SEQ ID NO: 2235)

AR-3767 Target:  5'-CAGTTCACTTTTGACCTGCTAATCAAG-3'    (SEQ ID NO: 2640)

5'-AGUUCACUUUUGACCUGCUAAUCAAGU-3'   (SEQ ID NO: 5137)
                 3'-UCAAGUGAAAACUGGACGAUUAGUUCA-5'   (SEQ ID NO: 2236)

AR-3768 Target:  5'-AGTTCACTTTTGACCTGCTAATCAAGT-3'    (SEQ ID NO: 2641)

5'-GUUCACUUUUGACCUGCUAAUCAAGUC-3'   (SEQ ID NO: 5138)
                 3'-CAAGUGAAAACUGGACGAUUAGUUCAG-5'   (SEQ ID NO: 2237)

AR-3769 Target:  5'-GTTCACTTTTGACCTGCTAATCAAGTC-3'    (SEQ ID NO: 2642)

5'-UUCACUUUUGACCUGCUAAUCAAGUCA-3'   (SEQ ID NO: 5139)
                 3'-AAGUGAAAACUGGACGAUUAGUUCAGU-5'   (SEQ ID NO: 2238)

AR-3770 Target:  5'-TTCACTTTTGACCTGCTAATCAAGTCA-3'    (SEQ ID NO: 2643)

5'-UCACUUUUGACCUGCUAAUCAAGUCAC-3'   (SEQ ID NO: 5140)
                 3'-AGUGAAAACUGGACGAUUAGUUCAGUG-5'   (SEQ ID NO: 2239)

AR-3771 Target:  5'-TCACTTTTGACCTGCTAATCAAGTCAC-3'    (SEQ ID NO: 2644)

5'-CACUUUUGACCUGCUAAUCAAGUCACA-3'   (SEQ ID NO: 5141)
                 3'-GUGAAAACUGGACGAUUAGUUCAGUGU-5'   (SEQ ID NO: 2240)

AR-3772 Target:  5'-CACTTTTGACCTGCTAATCAAGTCACA-3'    (SEQ ID NO: 2645)

5'-ACUUUUGACCUGCUAAUCAAGUCACAC-3'   (SEQ ID NO: 5142)
                 3'-UGAAAACUGGACGAUUAGUUCAGUGUG-5'   (SEQ ID NO: 2241)

AR-3773 Target:  5'-ACTTTTGACCTGCTAATCAAGTCACAC-3'    (SEQ ID NO: 2646)

5'-ACAUGGUGAGCGUGGACUUUCCGGAAA-3'   (SEQ ID NO: 5143)
                 3'-UGUACCACUCGCACCUGAAAGGCCUUU-5'   (SEQ ID NO: 2242)
```

TABLE 7-continued

Selected Human Anti-AR 27mer "Blunt/Blunt" DsiRNA Agents

```
AR-3798  Target:  5'-ACATGGTGAGCGTGGACTTTCCGGAAA-3'       (SEQ ID NO: 2647)

5'-CAUGGUGAGCGUGGACUUUCCGGAAAU-3'       (SEQ ID NO: 5144)
                  3'-GUACCACUCGCACCUGAAAGGCCUUUA-5'       (SEQ ID NO: 2243)

AR-3799  Target:  5'-CATGGTGAGCGTGGACTTTCCGGAAAT-3'       (SEQ ID NO: 2648)

5'-CGGAAAUGAUGGCAGAGAUCAUCUCUG-3'       (SEQ ID NO: 5145)
                  3'-GCCUUUACUACCGUCUCUAGUAGAGAC-5'       (SEQ ID NO: 2244)

AR-3819  Target:  5'-CGGAAATGATGGCAGAGATCATCTCTG-3'       (SEQ ID NO: 2649)

5'-GGAAAUGAUGGCAGAGAUCAUCUCUGU-3'       (SEQ ID NO: 5146)
                  3'-CCUUUACUACCGUCUCUAGUAGAGACA-5'       (SEQ ID NO: 2245)

AR-3820  Target:  5'-GGAAATGATGGCAGAGATCATCTCTGT-3'       (SEQ ID NO: 2650)

5'-GAAAUGAUGGCAGAGAUCAUCUCUGUG-3'       (SEQ ID NO: 5147)
                  3'-CUUUACUACCGUCUCUAGUAGAGACAC-5'       (SEQ ID NO: 2246)

AR-3821  Target:  5'-GAAATGATGGCAGAGATCATCTCTGTG-3'       (SEQ ID NO: 2651)

5'-AAAUGAUGGCAGAGAUCAUCUCUGUGC-3'       (SEQ ID NO: 5148)
                  3'-UUUACUACCGUCUCUAGUAGAGACACG-5'       (SEQ ID NO: 2247)

AR-3822  Target:  5'-AAATGATGGCAGAGATCATCTCTGTGC-3'       (SEQ ID NO: 2652)

5'-AAUGAUGGCAGAGAUCAUCUCUGUGCA-3'       (SEQ ID NO: 5149)
                  3'-UUACUACCGUCUCUAGUAGAGACACGU-5'       (SEQ ID NO: 2248)

AR-3823  Target:  5'-AATGATGGCAGAGATCATCTCTGTGCA-3'       (SEQ ID NO: 2653)

5'-AUGAUGGCAGAGAUCAUCUCUGUGCAA-3'       (SEQ ID NO: 5150)
                  3'-UACUACCGUCUCUAGUAGAGACACGUU-5'       (SEQ ID NO: 2249)

AR-3824  Target:  5'-ATGATGGCAGAGATCATCTCTGTGCAA-3'       (SEQ ID NO: 2654)

5'-UGAUGGCAGAGAUCAUCUCUGUGCAAG-3'       (SEQ ID NO: 5151)
                  3'-ACUACCGUCUCUAGUAGAGACACGUUC-5'       (SEQ ID NO: 2250)

AR-3825  Target:  5'-TGATGGCAGAGATCATCTCTGTGCAAG-3'       (SEQ ID NO: 2655)

5'-GAUGGCAGAGAUCAUCUCUGUGCAAGU-3'       (SEQ ID NO: 5152)
                  3'-CUACCGUCUCUAGUAGAGACACGUUCA-5'       (SEQ ID NO: 2251)

AR-3826  Target:  5'-GATGGCAGAGATCATCTCTGTGCAAGT-3'       (SEQ ID NO: 2656)

5'-AUGGCAGAGAUCAUCUCUGUGCAAGUG-3'       (SEQ ID NO: 5153)
                  3'-UACCGUCUCUAGUAGAGACACGUUCAC-5'       (SEQ ID NO: 2252)

AR-3827  Target:  5'-ATGGCAGAGATCATCTCTGTGCAAGTG-3'       (SEQ ID NO: 2657)

5'-UGGCAGAGAUCAUCUCUGUGCAAGUGC-3'       (SEQ ID NO: 5154)
                  3'-ACCGUCUCUAGUAGAGACACGUUCACG-5'       (SEQ ID NO: 2253)

AR-3828  Target:  5'-TGGCAGAGATCATCTCTGTGCAAGTGC-3'       (SEQ ID NO: 2658)

5'-GGCAGAGAUCAUCUCUGUGCAAGUGCC-3'       (SEQ ID NO: 5155)
                  3'-CCGUCUCUAGUAGAGACACGUUCACGG-5'       (SEQ ID NO: 2254)

AR-3829  Target:  5'-GGCAGAGATCATCTCTGTGCAAGTGCC-3'       (SEQ ID NO: 2659)

5'-GCAGAGAUCAUCUCUGUGCAAGUGCCC-3'       (SEQ ID NO: 5156)
                  3'-CGUCUCUAGUAGAGACACGUUCACGGG-5'       (SEQ ID NO: 2255)

AR-3830  Target:  5'-GCAGAGATCATCTCTGTGCAAGTGCCC-3'       (SEQ ID NO: 2660)

5'-CAGAGAUCAUCUCUGUGCAAGUGCCCA-3'       (SEQ ID NO: 5157)
                  3'-GUCUCUAGUAGAGACACGUUCACGGGU-5'       (SEQ ID NO: 2256)

AR-3831  Target:  5'-CAGAGATCATCTCTGTGCAAGTGCCCA-3'       (SEQ ID NO: 2661)

5'-AGAGAUCAUCUCUGUGCAAGUGCCCAA-3'       (SEQ ID NO: 5158)
                  3'-UCUCUAGUAGAGACACGUUCACGGGUU-5'       (SEQ ID NO: 2257)
```

TABLE 7-continued

Selected Human Anti-AR 27mer "Blunt/Blunt" DsiRNA Agents

```
AR-3832 Target:  5'-AGAGATCATCTCTGTGCAAGTGCCCAA-3'     (SEQ ID NO: 2662)

5'-GAGAUCAUCUCUGUGCAAGUGCCCAAG-3'    (SEQ ID NO: 5159)
                 3'-CUCUAGUAGAGACACGUUCACGGGUUC-5'    (SEQ ID NO: 2258)

AR-3833 Target:  5'-GAGATCATCTCTGTGCAAGTGCCCAAG-3'    (SEQ ID NO: 2663)

5'-AGAUCAUCUCUGUGCAAGUGCCCAAGA-3'   (SEQ ID NO: 5160)
                 3'-UCUAGUAGAGACACGUUCACGGGUUCU-5'   (SEQ ID NO: 2259)

AR-3834 Target:  5'-AGATCATCTCTGTGCAAGTGCCCAAGA-3'   (SEQ ID NO: 2664)

5'-GAUCAUCUCUGUGCAAGUGCCCAAGAU-3'  (SEQ ID NO: 5161)
                 3'-CUAGUAGAGACACGUUCACGGGUUCUA-5'  (SEQ ID NO: 2260)

AR-3835 Target:  5'-GATCATCTCTGTGCAAGTGCCCAAGAT-3'  (SEQ ID NO: 2665)

5'-AUCAUCUCUGUGCAAGUGCCCAAGAUC-3' (SEQ ID NO: 5162)
                 3'-UAGUAGAGACACGUUCACGGGUUCUAG-5' (SEQ ID NO: 2261)

AR-3836 Target:  5'-ATCATCTCTGTGCAAGTGCCCAAGATC-3' (SEQ ID NO: 2666)

5'-UCAUCUCUGUGCAAGUGCCCAAGAUCC-3' (SEQ ID NO: 5163)
                 3'-AGUAGAGACACGUUCACGGGUUCUAGG-5' (SEQ ID NO: 2262)

AR-3837 Target:  5'-TCATCTCTGTGCAAGTGCCCAAGATCC-3' (SEQ ID NO: 2667)

5'-CAUCUCUGUGCAAGUGCCCAAGAUCCU-3' (SEQ ID NO: 5164)
                 3'-GUAGAGACACGUUCACGGGUUCUAGGA-5' (SEQ ID NO: 2263)

AR-3838 Target:  5'-CATCTCTGTGCAAGTGCCCAAGATCCT-3' (SEQ ID NO: 2668)

5'-AUCUCUGUGCAAGUGCCCAAGAUCCUU-3' (SEQ ID NO: 5165)
                 3'-UAGAGACACGUUCACGGGUUCUAGGAA-5' (SEQ ID NO: 2264)

AR-3839 Target:  5'-ATCTCTGTGCAAGTGCCCAAGATCCTT-3' (SEQ ID NO: 2669)

5'-UCUCUGUGCAAGUGCCCAAGAUCCUUU-3' (SEQ ID NO: 5166)
                 3'-AGAGACACGUUCACGGGUUCUAGGAAA-5' (SEQ ID NO: 2265)

AR-3840 Target:  5'-TCTCTGTGCAAGTGCCCAAGATCCTTT-3' (SEQ ID NO: 2670)

5'-CUCUGUGCAAGUGCCCAAGAUCCUUUC-3' (SEQ ID NO: 5167)
                 3'-GAGACACGUUCACGGGUUCUAGGAAAG-5' (SEQ ID NO: 2266)

AR-3841 Target:  5'-CTCTGTGCAAGTGCCCAAGATCCTTTC-3' (SEQ ID NO: 2671)

5'-UCUGUGCAAGUGCCCAAGAUCCUUUCU-3' (SEQ ID NO: 5168)
                 3'-AGACACGUUCACGGGUUCUAGGAAAGA-5' (SEQ ID NO: 2267)

AR-3842 Target:  5'-TCTGTGCAAGTGCCCAAGATCCTTTCT-3' (SEQ ID NO: 2672)

5'-CUGUGCAAGUGCCCAAGAUCCUUUCUG-3' (SEQ ID NO: 5169)
                 3'-GACACGUUCACGGGUUCUAGGAAAGAC-5' (SEQ ID NO: 2268)

AR-3843 Target:  5'-CTGTGCAAGTGCCCAAGATCCTTTCTG-3' (SEQ ID NO: 2673)

5'-UGUGCAAGUGCCCAAGAUCCUUUCUGG-3' (SEQ ID NO: 5170)
                 3'-ACACGUUCACGGGUUCUAGGAAAGACC-5' (SEQ ID NO: 2269)

AR-3844 Target:  5'-TGTGCAAGTGCCCAAGATCCTTTCTGG-3' (SEQ ID NO: 2674)

5'-GUGCAAGUGCCCAAGAUCCUUUCUGGG-3' (SEQ ID NO: 5171)
                 3'-CACGUUCACGGGUUCUAGGAAAGACCC-5' (SEQ ID NO: 2270)

AR-3845 Target:  5'-GTGCAAGTGCCCAAGATCCTTTCTGGG-3' (SEQ ID NO: 2675)

5'-UGCAAGUGCCCAAGAUCCUUUCUGGGA-3' (SEQ ID NO: 5172)
                 3'-ACGUUCACGGGUUCUAGGAAAGACCCU-5' (SEQ ID NO: 2271)

AR-3846 Target:  5'-TGCAAGTGCCCAAGATCCTTTCTGGGA-3' (SEQ ID NO: 2676)

5'-GCAAGUGCCCAAGAUCCUUUCUGGGAA-3' (SEQ ID NO: 5173)
                 3'-CGUUCACGGGUUCUAGGAAAGACCCUU-5' (SEQ ID NO: 2272)
```

TABLE 7-continued

Selected Human Anti-AR 27mer "Blunt/Blunt" DsiRNA Agents

```
AR-3847 Target:  5'-GCAAGTGCCCAAGATCCTTTCTGGGAA-3'   (SEQ ID NO: 2677)

5'-CAAGUGCCCAAGAUCCUUUCUGGGAAA-3'  (SEQ ID NO: 5174)
                 3'-GUUCACGGGUUCUAGGAAAGACCCUUU-5'  (SEQ ID NO: 2273)

AR-3848 Target:  5'-CAAGTGCCCAAGATCCTTTCTGGGAAA-3'  (SEQ ID NO: 2678)

5'-AAGUGCCCAAGAUCCUUUCUGGGAAAG-3'  (SEQ ID NO: 5175)
                 3'-UUCACGGGUUCUAGGAAAGACCCUUUC-5'  (SEQ ID NO: 2274)

AR-3849 Target:  5'-AAGTGCCCAAGATCCTTTCTGGGAAAG-3'  (SEQ ID NO: 2679)

5'-AGUGCCCAAGAUCCUUUCUGGGAAAGU-3'  (SEQ ID NO: 5176)
                 3'-UCACGGGUUCUAGGAAAGACCCUUUCA-5'  (SEQ ID NO: 2275)

AR-3850 Target:  5'-AGTGCCCAAGATCCTTTCTGGGAAAGT-3'  (SEQ ID NO: 2680)

5'-GUGCCCAAGAUCCUUUCUGGGAAAGUC-3'  (SEQ ID NO: 5177)
                 3'-CACGGGUUCUAGGAAAGACCCUUUCAG-5'  (SEQ ID NO: 2276)

AR-3851 Target:  5'-GTGCCCAAGATCCTTTCTGGGAAAGTC-3'  (SEQ ID NO: 2681)

5'-UGCCCAAGAUCCUUUCUGGGAAAGUCA-3'  (SEQ ID NO: 5178)
                 3'-ACGGGUUCUAGGAAAGACCCUUUCAGU-5'  (SEQ ID NO: 2277)

AR-3852 Target:  5'-TGCCCAAGATCCTTTCTGGGAAAGTCA-3'  (SEQ ID NO: 2682)

5'-GCCCAAGAUCCUUUCUGGGAAAGUCAA-3'  (SEQ ID NO: 5179)
                 3'-CGGGUUCUAGGAAAGACCCUUUCAGUU-5'  (SEQ ID NO: 2278)

AR-3853 Target:  5'-GCCCAAGATCCTTTCTGGGAAAGTCAA-3'  (SEQ ID NO: 2683)

5'-CCCAAGAUCCUUUCUGGGAAAGUCAAG-3'  (SEQ ID NO: 5180)
                 3'-GGGUUCUAGGAAAGACCCUUUCAGUUC-5'  (SEQ ID NO: 2279)

AR-3854 Target:  5'-CCCAAGATCCTTTCTGGGAAAGTCAAG-3'  (SEQ ID NO: 2684)

5'-CCAAGAUCCUUUCUGGGAAAGUCAAGC-3'  (SEQ ID NO: 5181)
                 3'-GGUUCUAGGAAAGACCCUUUCAGUUCG-5'  (SEQ ID NO: 2280)

AR-3855 Target:  5'-CCAAGATCCTTTCTGGGAAAGTCAAGC-3'  (SEQ ID NO: 2685)

5'-CAAGAUCCUUUCUGGGAAAGUCAAGCC-3'  (SEQ ID NO: 5182)
                 3'-GUUCUAGGAAAGACCCUUUCAGUUCGG-5'  (SEQ ID NO: 2281)

AR-3856 Target:  5'-CAAGATCCTTTCTGGGAAAGTCAAGCC-3'  (SEQ ID NO: 2686)

5'-AAGAUCCUUUCUGGGAAAGUCAAGCCC-3'  (SEQ ID NO: 5183)
                 3'-UUCUAGGAAAGACCCUUUCAGUUCGGG-5'  (SEQ ID NO: 2282)

AR-3857 Target:  5'-AAGATCCTTTCTGGGAAAGTCAAGCCC-3'  (SEQ ID NO: 2687)

5'-AGAUCCUUUCUGGGAAAGUCAAGCCCA-3'  (SEQ ID NO: 5184)
                 3'-UCUAGGAAAGACCCUUUCAGUUCGGGU-5'  (SEQ ID NO: 2283)

AR-3858 Target:  5'-AGATCCTTTCTGGGAAAGTCAAGCCCA-3'  (SEQ ID NO: 2688)

5'-GAUCCUUUCUGGGAAAGUCAAGCCCAU-3'  (SEQ ID NO: 5185)
                 3'-CUAGGAAAGACCCUUUCAGUUCGGGUA-5'  (SEQ ID NO: 2284)

AR-3859 Target:  5'-GATCCTTTCTGGGAAAGTCAAGCCCAT-3'  (SEQ ID NO: 2689)

5'-AUCCUUUCUGGGAAAGUCAAGCCCAUC-3'  (SEQ ID NO: 5186)
                 3'-UAGGAAAGACCCUUUCAGUUCGGGUAG-5'  (SEQ ID NO: 2285)

AR-3860 Target:  5'-ATCCTTTCTGGGAAAGTCAAGCCCATC-3'  (SEQ ID NO: 2690)

5'-UCCUUUCUGGGAAAGUCAAGCCCAUCU-3'  (SEQ ID NO: 5187)
                 3'-AGGAAAGACCCUUUCAGUUCGGGUAGA-5'  (SEQ ID NO: 2286)

AR-3861 Target:  5'-TCCTTTCTGGGAAAGTCAAGCCCATCT-3'  (SEQ ID NO: 2691)

5'-CCUUUCUGGGAAAGUCAAGCCCAUCUA-3'  (SEQ ID NO: 5188)
                 3'-GGAAAGACCCUUUCAGUUCGGGUAGAU-5'  (SEQ ID NO: 2287)
```

TABLE 7-continued

Selected Human Anti-AR 27mer "Blunt/Blunt" DsiRNA Agents

```
AR-3862 Target:  5'-CCTTTCTGGGAAAGTCAAGCCCATCTA-3'   (SEQ ID NO: 2692)

5'-CUUUCUGGGAAAGUCAAGCCCAUCUAU-3'   (SEQ ID NO: 5189)
                 3'-GAAAGACCCUUUCAGUUCGGGUAGAUA-5'   (SEQ ID NO: 2288)

AR-3863 Target:  5'-CTTTCTGGGAAAGTCAAGCCCATCTAT-3'   (SEQ ID NO: 2693)

5'-UUUCUGGGAAAGUCAAGCCCAUCUAUU-3'   (SEQ ID NO: 5190)
                 3'-AAAGACCCUUUCAGUUCGGGUAGAUAA-5'   (SEQ ID NO: 2289)

AR-3864 Target:  5'-TTTCTGGGAAAGTCAAGCCCATCTATT-3'   (SEQ ID NO: 2694)

5'-UUCUGGGAAAGUCAAGCCCAUCUAUUU-3'   (SEQ ID NO: 5191)
                 3'-AAGACCCUUUCAGUUCGGGUAGAUAAA-5'   (SEQ ID NO: 2290)

AR-3865 Target:  5'-TTCTGGGAAAGTCAAGCCCATCTATTT-3'   (SEQ ID NO: 2695)

5'-UCUGGGAAAGUCAAGCCCAUCUAUUUC-3'   (SEQ ID NO: 5192)
                 3'-AGACCCUUUCAGUUCGGGUAGAUAAAG-5'   (SEQ ID NO: 2291)

AR-3866 Target:  5'-TCTGGGAAAGTCAAGCCCATCTATTTC-3'   (SEQ ID NO: 2696)

5'-CUGGGAAAGUCAAGCCCAUCUAUUUCC-3'   (SEQ ID NO: 5193)
                 3'-GACCCUUUCAGUUCGGGUAGAUAAAGG-5'   (SEQ ID NO: 2292)

AR-3867 Target:  5'-CTGGGAAAGTCAAGCCCATCTATTTCC-3'   (SEQ ID NO: 2697)

5'-UGGGAAAGUCAAGCCCAUCUAUUUCCA-3'   (SEQ ID NO: 5194)
                 3'-ACCCUUUCAGUUCGGGUAGAUAAAGGU-5'   (SEQ ID NO: 2293)

AR-3868 Target:  5'-TGGGAAAGTCAAGCCCATCTATTTCCA-3'   (SEQ ID NO: 2698)

5'-GGGAAAGUCAAGCCCAUCUAUUUCCAC-3'   (SEQ ID NO: 5195)
                 3'-CCCUUUCAGUUCGGGUAGAUAAAGGUG-5'   (SEQ ID NO: 2294)

AR-3869 Target:  5'-GGGAAAGTCAAGCCCATCTATTTCCAC-3'   (SEQ ID NO: 2699)

5'-GGAAAGUCAAGCCCAUCUAUUUCCACA-3'   (SEQ ID NO: 5196)
                 3'-CCUUUCAGUUCGGGUAGAUAAAGGUGU-5'   (SEQ ID NO: 2295)

AR-3870 Target:  5'-GGAAAGTCAAGCCCATCTATTTCCACA-3'   (SEQ ID NO: 2700)

5'-GAAAGUCAAGCCCAUCUAUUUCCACAC-3'   (SEQ ID NO: 5197)
                 3'-CUUUCAGUUCGGGUAGAUAAAGGUGUG-5'   (SEQ ID NO: 2296)

AR-3871 Target:  5'-GAAAGTCAAGCCCATCTATTTCCACAC-3'   (SEQ ID NO: 2701)

5'-UUCAGAUGUCUUCUGCCUGUUAUAACU-3'   (SEQ ID NO: 5198)
                 3'-AAGUCUACAGAAGACGGACAAUAUUGA-5'   (SEQ ID NO: 2297)

AR-3947 Target:  5'-TTCAGATGTCTTCTGCCTGTTATAACT-3'   (SEQ ID NO: 2702)

5'-UCAGAUGUCUUCUGCCUGUUAUAACUC-3'   (SEQ ID NO: 5199)
                 3'-AGUCUACAGAAGACGGACAAUAUUGAG-5'   (SEQ ID NO: 2298)

AR-3948 Target:  5'-TCAGATGTCTTCTGCCTGTTATAACTC-3'   (SEQ ID NO: 2703)

5'-CAGAUGUCUUCUGCCUGUUAUAACUCU-3'   (SEQ ID NO: 5200)
                 3'-GUCUACAGAAGACGGACAAUAUUGAGA-5'   (SEQ ID NO: 2299)

AR-3949 Target:  5'-CAGATGTCTTCTGCCTGTTATAACTCT-3'   (SEQ ID NO: 2704)

5'-AGAUGUCUUCUGCCUGUUAUAACUCUG-3'   (SEQ ID NO: 5201)
                 3'-UCUACAGAAGACGGACAAUAUUGAGAC-5'   (SEQ ID NO: 2300)

AR-3950 Target:  5'-AGATGTCTTCTGCCTGTTATAACTCTG-3'   (SEQ ID NO: 2705)

5'-GGGGAAUUUCCUCUAUUGAUGUACAGU-3'   (SEQ ID NO: 5202)
                 3'-CCCCUUAAAGGAGAUAACUACAUGUCA-5'   (SEQ ID NO: 2301)

AR-3999 Target:  5'-GGGGAATTTCCTCTATTGATGTACAGT-3'   (SEQ ID NO: 2706)

5'-UUGCUGGGCUUUUUUUUUCUCUUUCUC-3'   (SEQ ID NO: 5203)
                 3'-AACGACCCGAAAAAAAAAGAGAAAGAG-5'   (SEQ ID NO: 2302)
```

TABLE 7-continued

Selected Human Anti-AR 27mer "Blunt/Blunt" DsiRNA Agents

```
AR-4054 Target:  5'-TTGCTGGGCTTTTTTTTCTCTTTCTC-3'    (SEQ ID NO: 2707)

5'-UGCUGGGCUUUUUUUUCUCUUUCUCU-3'    (SEQ ID NO: 5204)
                 3'-ACGACCCGAAAAAAAAAGAGAAAGAGA-5'   (SEQ ID NO: 2303)

AR-4055 Target:  5'-TGCTGGGCTTTTTTTTCTCTTTCTCT-3'    (SEQ ID NO: 2708)

5'-GCUUUUUUUUCUCUUUCUCUCCUUUC-3'    (SEQ ID NO: 5205)
                 3'-CGAAAAAAAAAGAGAAAGAGAGGAAAG-5'   (SEQ ID NO: 2304)

AR-4061 Target:  5'-GCTTTTTTTTCTCTTTCTCTCCTTTC-3'    (SEQ ID NO: 2709)

5'-UUUUUUCUCUUUCUCUCCUUUCUUUUU-3'   (SEQ ID NO: 5206)
                 3'-AAAAAAGAGAAAGAGAGGAAAGAAAAA-5'   (SEQ ID NO: 2305)

AR-4066 Target:  5'-TTTTTTCTCTTTCTCTCCTTTCTTTTT-3'   (SEQ ID NO: 2710)

5'-UCUUUUUCUUCUUCCCUCCCUAUCUAA-3'   (SEQ ID NO: 5207)
                 3'-AGAAAAAGAAGAAGGGAGGGAUAGAUU-5'   (SEQ ID NO: 2306)

AR-4086 Target:  5'-TCTTTTTCTTCTTCCCTCCCTATCTAA-3'   (SEQ ID NO: 2711)

5'-UGUUGUAUGCCUUUAAAUCUGUGAUGA-3'   (SEQ ID NO: 5208)
                 3'-ACAACAUACGGAAAUUUAGACACUACU-5'   (SEQ ID NO: 2307)

AR-4174 Target:  5'-TGTTGTATGCCTTTAAATCTGTGATGA-3'   (SEQ ID NO: 2712)

5'-UGUGCUUGUUUACAGCACUACUCUGUG-3'   (SEQ ID NO: 5209)
                 3'-ACACGAACAAAUGUCGUGAUGAGACAC-5'   (SEQ ID NO: 2308)

AR-4225 Target:  5'-TGTGCTTGTTTACAGCACTACTCTGTG-3'   (SEQ ID NO: 2713)

5'-UUAGAGAGCUAAGAUUAUCUGGGGAAA-3'   (SEQ ID NO: 5210)
                 3'-AAUCUCUCGAUUCUAAUAGACCCCUUU-5'   (SEQ ID NO: 2309)

AR-4293 Target:  5'-TTAGAGAGCTAAGATTATCTGGGGAAA-3'   (SEQ ID NO: 2714)

5'-GGGGAAAUCAAAACAAAAACAAGCAAA-3'   (SEQ ID NO: 5211)
                 3'-CCCCUUUAGUUUUGUUUUUGUUCGUUU-5'   (SEQ ID NO: 2310)

AR-4313 Target:  5'-GGGGAAATCAAAACAAAAACAAGCAAA-3'   (SEQ ID NO: 2715)
```

TABLE 8

Selected Mouse Anti-AR 27mer "Blunt/Blunt" DsiRNA Agents

```
                 5'-GGCAGCAGCACACUGAGGAUGGUUCUC-3'   (SEQ ID NO: 5182)
                 3'-CCGUCGUCGUGUGACUCCUACCAAGAG-5'   (SEQ ID NO: 3574)

AR-m258 Target:  5'-GGCAGCAGCACACTGAGGATGGTTCTC-3'   (SEQ ID NO: 3622)

5'-CUCCGAGGGCCACCCUGAGAGCAGCUG-3'   (SEQ ID NO: 5183)
                 3'-GAGGCUCCCGGUGGGACUCUCGUCGAC-5'   (SEQ ID NO: 3575)

AR-m361 Target:  5'-CTCCGAGGGCCACCCTGAGAGCAGCTG-3'   (SEQ ID NO: 3623)

5'-GGGCCACCCUGAGAGCAGCUGCCUCCC-3'   (SEQ ID NO: 5184)
                 3'-CCCGGUGGGACUCUCGUCGACGGAGGG-5'   (SEQ ID NO: 3576)

AR-m367 Target:  5'-GGGCCACCCTGAGAGCAGCTGCCTCCC-3'   (SEQ ID NO: 3624)

5'-GGCUGCCGCAGCAGCCACCAGCUCCUC-3'   (SEQ ID NO: 5185)
                 3'-CCGACGGCGUCGUCGGUGGUCGAGGAG-5'   (SEQ ID NO: 3577)

AR-m426 Target:  5'-GGCTGCCGCAGCAGCCACCAGCTCCTC-3'   (SEQ ID NO: 3625)

5'-CACUUUCCCAGGCUUAAGCAGCUGCUC-3'   (SEQ ID NO: 5186)
                 3'-GUGAAAGGGUCCGAAUUCGUCGACGAG-5'   (SEQ ID NO: 3578)
```

TABLE 8-continued

Selected Mouse Anti-AR 27mer "Blunt/Blunt" DsiRNA Agents

```
AR-m502 Target:   5'-CACTTTCCCAGGCTTAAGCAGCTGCTC-3'   (SEQ ID NO: 3626)

5'-AUGCAACUUCUUCAGCAGCAGCAACAA-3'   (SEQ ID NO: 5187)
                  3'-UACGUUGAAGAAGUCGUCGUCGUUGUU-5'   (SEQ ID NO: 3579)

AR-m566 Target:   5'-ATGCAACTTCTTCAGCAGCAGCAACAA-3'   (SEQ ID NO: 3627)

5'-GUGCGUCCCACUCCUUGUGCGCCGCUG-3'   (SEQ ID NO: 5188)
                  3'-CACGCAGGGUGAGGAACACGCGGCGAC-5'   (SEQ ID NO: 3580)

AR-m872 Target:   5'-GTGCGTCCCACTCCTTGTGCGCCGCTG-3'   (SEQ ID NO: 3628)

5'-CUGGCAGCAGUGAAGCAGGUAGCUCUG-3'   (SEQ ID NO: 5189)
                  3'-GACCGUCGUCACUUCGUCCAUCGAGAC-5'   (SEQ ID NO: 3581)

AR-m1020 Target:  5'-CTGGCAGCAGTGAAGCAGGTAGCTCTG-3'   (SEQ ID NO: 3629)

5'-UUUCCGCUGGCUCUGUCCGGGCCGCCG-3'   (SEQ ID NO: 5190)
                  3'-AAAGGCGACCGAGACAGGCCCGGCGGC-5'   (SEQ ID NO: 3582)

AR-m1136 Target:  5'-TTTCCGCTGGCTCTGTCCGGGCCGCCG-3'   (SEQ ID NO: 3630)

5'-GCAGCGCCUGGGCUGCGGCGGCAGCGC-3'   (SEQ ID NO: 5191)
                  3'-CGUCGCGGACCCGACGCCGCCGUCGCG-5'   (SEQ ID NO: 3583)

AR-m1224 Target:  5'-GCAGCGCCTGGGCTGCGGCGGCAGCGC-3'   (SEQ ID NO: 3631)

5'-GCCUGGGCUGCGGCGGCAGCGCAAUGC-3'   (SEQ ID NO: 5192)
                  3'-CGGACCCGACGCCGCCGUCGCGUUACG-5'   (SEQ ID NO: 3584)

AR-m1229 Target:  5'-GCCTGGGCTGCGGCGGCAGCGCAATGC-3'   (SEQ ID NO: 3632)

5'-CUGCGGCGGCAGCGCAAUGCCGCUAUG-3'   (SEQ ID NO: 5193)
                  3'-GACGCCGCCGUCGCGUUACGGCGAUAC-5'   (SEQ ID NO: 3585)

AR-m1236 Target:  5'-CTGCGGCGGCAGCGCAATGCCGCTATG-3'   (SEQ ID NO: 3633)

5'-UGUAGCCGGGCCCAGCACUGGAUCGCC-3'   (SEQ ID NO: 5194)
                  3'-ACAUCGGCCCGGGUCGUGACCUAGCGG-5'   (SEQ ID NO: 3586)

AR-m1291 Target:  5'-TGTAGCCGGGCCCAGCACTGGATCGCC-3'   (SEQ ID NO: 3634)

5'-CUUCCUGGCAUACUCUCUUCACAGCUG-3'   (SEQ ID NO: 5195)
                  3'-GAAGGACCGUAUGAGAGAAGUGUCGAC-5'   (SEQ ID NO: 3587)

AR-m1335 Target:  5'-CTTCCTGGCATACTCTCTTCACAGCTG-3'   (SEQ ID NO: 3635)

5'-AGCAGCCCAAGCGAUGCCGGGCCUGUA-3'   (SEQ ID NO: 5196)
                  3'-UCGUCGGGUUCGCUACGGCCCGGACAU-5'   (SEQ ID NO: 3588)

AR-m1403 Target:  5'-AGCAGCCCAAGCGATGCCGGGCCTGTA-3'   (SEQ ID NO: 3636)

5'-GCUUCUGGCUGUCACUACGGAGCUCUC-3'   (SEQ ID NO: 5197)
                  3'-CGAAGACCGACAGUGAUGCCUCGAGAG-5'   (SEQ ID NO: 3589)

AR-m1694 Target:  5'-GCTTCTGGCTGTCACTACGGAGCTCTC-3'   (SEQ ID NO: 3637)

5'-CGGAGCUCUCACUUGUGGCAGCUGCAA-3'   (SEQ ID NO: 5198)
                  3'-GCCUCGAGAGUGAACACCGUCGACGUU-5'   (SEQ ID NO: 3590)

AR-m1711 Target:  5'-CGGAGCTCTCACTTGTGGCAGCTGCAA-3'   (SEQ ID NO: 3638)

5'-CACUUGUGGCAGCUGCAAGGUCUUCUU-3'   (SEQ ID NO: 5199)
                  3'-GUGAACACCGUCGACGUUCCAGAAGAA-5'   (SEQ ID NO: 3591)

AR-m1720 Target:  5'-CACTTGTGGCAGCTGCAAGGTCTTCTT-3'   (SEQ ID NO: 3639)

5'-GUGGCAGCUGCAAGGUCUUCUUCAAAA-3'   (SEQ ID NO: 5200)
                  3'-CACCGUCGACGUUCCAGAAGAAGUUUU-5'   (SEQ ID NO: 3592)

AR-m1725 Target:  5'-GTGGCAGCTGCAAGGTCTTCTTCAAAA-3'   (SEQ ID NO: 3640)

5'-GGGAUGACUCUGGGAGCUCUAAGCUG-3'    (SEQ ID NO: 5201)
                  3'-CCCUACUGAGACCCUCGAGCAUUCGAC-5'   (SEQ ID NO: 3593)
```

TABLE 8-continued

Selected Mouse Anti-AR 27mer "Blunt/Blunt" DsiRNA Agents

```
AR-m1865 Target: 5'-GGGATGACTCTGGGAGCTCGTAAGCTG-3'   (SEQ ID NO: 3641)

5'-CUGGGAGCUCGUAAGCUGAAGAAACUU-3'  (SEQ ID NO: 5202)
                  3'-GACCCUCGAGCAUUCGACUUCUUUGAA-5'  (SEQ ID NO: 3594)

AR-m1874 Target: 5'-CTGGGAGCTCGTAAGCTGAAGAAACTT-3'   (SEQ ID NO: 3642)

5'-CAGAUUCCUUUGCUGCCUUGUUAUCUA-3'  (SEQ ID NO: 5203)
                  3'-GUCUAAGGAAACGACGGAACAAUAGAU-5'  (SEQ ID NO: 3595)

AR-m2079 Target: 5'-CAGATTCCTTTGCTGCCTTGTTATCTA-3'   (SEQ ID NO: 3643)

5'-CUUUGCUGCCUUGUUAUCUAGCCUCAA-3'  (SEQ ID NO: 5204)
                  3'-GAAACGACGGAACAAUAGAUCGGAGUU-5'  (SEQ ID NO: 3596)

AR-m2086 Target: 5'-CTTTGCTGCCTTGTTATCTAGCCTCAA-3'   (SEQ ID NO: 3644)

5'-UUGCCUGGCUUCCGCAACUUGCAUGUG-3'  (SEQ ID NO: 5205)
                  3'-AACGGACCGAAGGCGUUGAACGUACAC-5'  (SEQ ID NO: 3597)

AR-m2162 Target: 5'-TTGCCTGGCTTCCGCAACTTGCATGTG-3'   (SEQ ID NO: 3645)

5'-UGGAUGGGACUGAUGGUAUUUGCCAUG-3'  (SEQ ID NO: 5206)
                  3'-ACCUACCCUGACUACCAUAAACGGUAC-5'  (SEQ ID NO: 3598)

AR-m2219 Target: 5'-TGGATGGGACTGATGGTATTTGCCATG-3'   (SEQ ID NO: 3646)

5'-CAGGAUGCUCUACUUUGCACCUGACUU-3'  (SEQ ID NO: 5207)
                  3'-GUCCUACGAGAUGAAACGUGGACUGAA-5'  (SEQ ID NO: 3599)

AR-m2275 Target: 5'-CAGGATGCTCTACTTTGCACCTGACTT-3'   (SEQ ID NO: 3647)

5'-UGCUCUACUUUGCACCUGACUUGGUUU-3'  (SEQ ID NO: 5208)
                  3'-ACGAGAUGAAACGUGGACUGAACCAAA-5'  (SEQ ID NO: 3600)

AR-m2280 Target: 5'-TGCTCTACTTTGCACCTGACTTGGTTT-3'   (SEQ ID NO: 3648)

5'-CUUUGCACCUGACUUGGUUUUCAAUGA-3'  (SEQ ID NO: 5209)
                  3'-GAAACGUGGACUGAACCAAAAGUUACU-5'  (SEQ ID NO: 3601)

AR-m2287 Target: 5'-CTTTGCACCTGACTTGGTTTTCAATGA-3'   (SEQ ID NO: 3649)

5'-GACUUGGUUUUCAAUGAGUACCGCAUG-3'  (SEQ ID NO: 5210)
                  3'-CUGAACCAAAAGUUACUCAUGGCGUAC-5'  (SEQ ID NO: 3602)

AR-m2297 Target: 5'-GACTTGGTTTTCAATGAGTACCGCATG-3'   (SEQ ID NO: 3650)

5'-GAGUACCGCAUGCACAAGUCUCGGAUG-3'  (SEQ ID NO: 5211)
                  3'-CUCAUGGCGUACGUGUUCAGAGCCUAC-5'  (SEQ ID NO: 3603)

AR-m2312 Target: 5'-GAGTACCGCATGCACAAGTCTCGGATG-3'   (SEQ ID NO: 3651)

5'-CUGUGCAUGAAAGCACUGCUGCUCUUC-3'  (SEQ ID NO: 5212)
                  3'-GACACGUACUUUCGUGACGACGAGAAG-5'  (SEQ ID NO: 3604)

AR-m2411 Target: 5'-CTGTGCATGAAAGCACTGCTGCTCTTC-3'   (SEQ ID NO: 3652)

5'-CAUGAAAGCACUGCUGCUCUUCAGCAU-3'  (SEQ ID NO: 5213)
                  3'-GUACUUUCGUGACGACGAGAAGUCGUA-5'  (SEQ ID NO: 3605)

AR-m2416 Target: 5'-CATGAAAGCACTGCTGCTCTTCAGCAT-3'   (SEQ ID NO: 3653)

5'-AGCACUGCUGCUCUUCAGCAUUAUUCC-3'  (SEQ ID NO: 5214)
                  3'-UCGUGACGACGAGAAGUCGUAAUAAGG-5'  (SEQ ID NO: 3606)

AR-m2422 Target: 5'-AGCACTGCTGCTCTTCAGCATTATTCC-3'   (SEQ ID NO: 3654)

5'-UGCUGCUCUUCAGCAUUAUUCCAGUGG-3'  (SEQ ID NO: 5215)
                  3'-ACGACGAGAAGUCGUAAUAAGGUCACC-5'  (SEQ ID NO: 3607)

AR-m2427 Target: 5'-TGCTGCTCTTCAGCATTATTCCAGTGG-3'   (SEQ ID NO: 3655)

5'-AGCUCACCAAGCUCCUGGAUUCUGUGC-3'  (SEQ ID NO: 5216)
                  3'-UCGAGUGGUUCGAGGACCUAAGACACG-5'  (SEQ ID NO: 3608)
```

TABLE 8-continued

Selected Mouse Anti-AR 27mer "Blunt/Blunt" DsiRNA Agents

```
AR-m2571 Target: 5'-AGCTCACCAAGCTCCTGGATTCTGTGC-3'   (SEQ ID NO: 3656)

5'-AGCUCCUGGAUUCUGUGCAGCCUAUUG-3'   (SEQ ID NO: 5217)
                 3'-UCGAGGACCUAAGACACGUCGGAUAAC-5'   (SEQ ID NO: 3609)

AR-m2580 Target: 5'-AGCTCCTGGATTCTGTGCAGCCTATTG-3'   (SEQ ID NO: 3657)

5'-CUGGAUUCUGUGCAGCCUAUUGCAAGA-3'   (SEQ ID NO: 5218)
                 3'-GACCUAAGACACGUCGGAUAACGUUCU-5'   (SEQ ID NO: 3610)

AR-m2585 Target: 5'-CTGGATTCTGTGCAGCCTATTGCAAGA-3'   (SEQ ID NO: 3658)

5'-UCUGUGCAGCCUAUUGCAAGAGAGCUG-3'   (SEQ ID NO: 5219)
                 3'-AGACACGUCGGAUAACGUUCUCUCGAC-5'   (SEQ ID NO: 3611)

AR-m2591 Target: 5'-TCTGTGCAGCCTATTGCAAGAGAGCTG-3'   (SEQ ID NO: 3659)

5'-CAGCCUAUUGCAAGAGAGCUGCAUCAG-3'   (SEQ ID NO: 5220)
                 3'-GUCGGAUAACGUUCUCUCGACGUAGUC-5'   (SEQ ID NO: 3612)

AR-m2597 Target: 5'-CAGCCTATTGCAAGAGAGCTGCATCAG-3'   (SEQ ID NO: 3660)

5'-GCGUGGACUUUCCUGAAAUGAUGGCAG-3'   (SEQ ID NO: 5221)
                 3'-CGCACCUGAAAGGACUUUACUACCGUC-5'   (SEQ ID NO: 3613)

AR-m2661 Target: 5'-GCGTGGACTTTCCTGAAATGATGGCAG-3'   (SEQ ID NO: 3661)

5'-UCUUCUGCCUGUUAUAUAACUCUGCAC-3'   (SEQ ID NO: 5222)
                 3'-AGAAGACGGACAAUAUAUUGAGACGUG-5'   (SEQ ID NO: 3614)

AR-m2809 Target: 5'-TCTTCTGCCTGTTATATAACTCTGCAC-3'   (SEQ ID NO: 3662)

5'-UGCACUACUUCUCUGCAGUGCCUUGGG-3'   (SEQ ID NO: 5223)
                 3'-ACGUGAUGAAGAGACGUCACGGAACCC-5'   (SEQ ID NO: 3615)

AR-m2831 Target: 5'-TGCACTACTTCTCTGCAGTGCCTTGGG-3'   (SEQ ID NO: 3663)

5'-UCCUGGGCUUCUCCUUCUUUUUUUUUC-3'   (SEQ ID NO: 5224)
                 3'-AGGACCCGAAGAGGAAGAAAAAAAAAG-5'   (SEQ ID NO: 3616)

AR-m2912 Target: 5'-TCCTGGGCTTCTCCTTCTTTTTTTTC-3'    (SEQ ID NO: 3664)

5'-GCUUCUCCUUCUUUUUUUUUCUUCUUC-3'   (SEQ ID NO: 5225)
                 3'-CGAAGAGGAAGAAAAAAAAAGAAGAAG-5'   (SEQ ID NO: 3617)

AR-m2918 Target: 5'-GCTTCTCCTTCTTTTTTTTCTTCTTC-3'    (SEQ ID NO: 3665)

5'-UUCUUUUUUUUCUUCUUCCCUCCCUC-3'    (SEQ ID NO: 5226)
                 3'-AAGAAAAAAAAGAAGAAGGGAGGGAG-5'    (SEQ ID NO: 3618)

AR-m2926 Target: 5'-TTCTTTTTTTTCTTCTTCCCTCCCTC-3'    (SEQ ID NO: 3666)

5'-CUGCUGCGUAUUGUGGCUCCUGCCUUU-3'   (SEQ ID NO: 5227)
                 3'-GACGACGCAUAACACCGAGGACGGAAA-5'   (SEQ ID NO: 3619)

AR-m2981 Target: 5'-CTGCTGCGTATTGTGGCTCCTGCCTTT-3'   (SEQ ID NO: 3667)

5'-UGUGGCUCCUGCCUUUGUUUUGAUUUC-3'   (SEQ ID NO: 5228)
                 3'-ACACCGAGGACGGAAACAAAACUAAAG-5'   (SEQ ID NO: 3620)

AR-m2992 Target: 5'-TGTGGCTCCTGCCTTTGTTTTGATTTC-3'   (SEQ ID NO: 3668)

5'-CUCCUGCCUUUGUUUUGAUUUCUGUUG-3'   (SEQ ID NO: 5229)
                 3'-GAGGACGGAAACAAAACUAAAGACAAC-5'   (SEQ ID NO: 3621)

AR-m2997 Target: 5'-CTCCTGCCTTTGTTTTGATTTCTGTTG-3'   (SEQ ID NO: 3669)
```

In certain embodiments, the DsiRNA agents of the invention require, e.g., at least 19, at least 20, at least 21, at least 22, at least 23, at least 24, at least 25 or at least 26 residues of the first strand to be complementary to corresponding residues of the second strand. In certain related embodiments, these first strand residues complementary to corresponding residues of the second strand are optionally consecutive residues.

As used herein "DsiRNAmm" refers to a DisRNA having a "mismatch tolerant region" containing one, two, three or four mismatched base pairs of the duplex formed by the sense and antisense strands of the DsiRNA, where such mismatches are positioned within the DsiRNA at a location(s) lying between (and thus not including) the two terminal base pairs of either end of the DsiRNA. The mismatched base pairs are located within a "mismatch-tolerant region" which is defined herein with respect to the location of the projected Ago2 cut site of the corresponding target nucleic acid. The mismatch tolerant region is located "upstream of" the projected Ago2 cut site of the target strand. "Upstream" in this context will be understood as the 5'-most portion of the DsiRNAmm duplex, where 5' refers to the orientation of the sense strand of the DsiRNA duplex. Therefore, the mismatch tolerant region is upstream of the base on the sense (passenger) strand that corresponds to the projected Ago2 cut site of the target nucleic acid (see FIG. 1); alternatively, when referring to the antisense (guide) strand of the DsiRNAmm, the mismatch tolerant region can also be described as positioned downstream of the base that is complementary to the projected Ago2 cut site of the target nucleic acid, that is, the 3'-most portion of the antisense strand of the DsiRNAmm (where position 1 of the antisense strand is the 5' terminal nucleotide of the antisense strand, see FIG. 1).

In one embodiment, for example with numbering as depicted in FIG. 1, the mismatch tolerant region is positioned between and including base pairs 3-9 when numbered from the nucleotide starting at the 5' end of the sense strand of the duplex. Therefore, a DsiRNAmm of the invention possesses a single mismatched base pair at any one of positions 3, 4, 5, 6, 7, 8 or 9 of the sense strand of a right-hand extended DsiRNA (where position 1 is the 5' terminal nucleotide of the sense strand and position 9 is the nucleotide residue of the sense strand that is immediately 5' of the projected Ago2 cut site of the target AR RNA sequence corresponding to the sense strand sequence). In certain embodiments, for a DsiRNAmm that possesses a mismatched base pair nucleotide at any of positions 3, 4, 5, 6, 7, 8 or 9 of the sense strand, the corresponding mismatched base pair nucleotide of the antisense strand not only forms a mismatched base pair with the DsiRNAmm sense strand sequence, but also forms a mismatched base pair with a DsiRNAmm target AR RNA sequence (thus, complementarity between the antisense strand sequence and the sense strand sequence is disrupted at the mismatched base pair within the DsiRNAmm, and complementarity is similarly disrupted between the antisense strand sequence of the DsiRNAmm and the target AR RNA sequence). In alternative embodiments, the mismatch base pair nucleotide of the antisense strand of a DsiRNAmm only form a mismatched base pair with a corresponding nucleotide of the sense strand sequence of the DsiRNAmm, yet base pairs with its corresponding target AR RNA sequence nucleotide (thus, complementarity between the antisense strand sequence and the sense strand sequence is disrupted at the mismatched base pair within the DsiRNAmm, yet complementarity is maintained between the antisense strand sequence of the DsiRNAmm and the target AR RNA sequence).

A DsiRNAmm of the invention that possesses a single mismatched base pair within the mismatch-tolerant region (mismatch region) as described above (e.g., a DsiRNAmm harboring a mismatched nucleotide residue at any one of positions 3, 4, 5, 6, 7, 8 or 9 of the sense strand) can further include one, two or even three additional mismatched base pairs. In preferred embodiments, these one, two or three additional mismatched base pairs of the DsiRNAmm occur at position(s) 3, 4, 5, 6, 7, 8 and/or 9 of the sense strand (and at corresponding residues of the antisense strand). In one embodiment where one additional mismatched base pair is present within a DsiRNAmm, the two mismatched base pairs of the sense strand can occur, e.g., at nucleotides of both position 4 and position 6 of the sense strand (with mismatch also occurring at corresponding nucleotide residues of the antisense strand).

In DsiRNAmm agents possessing two mismatched base pairs, mismatches can occur consecutively (e.g., at consecutive positions along the sense strand nucleotide sequence). Alternatively, nucleotides of the sense strand that form mismatched base pairs with the antisense strand sequence can be interspersed by nucleotides that base pair with the antisense strand sequence (e.g., for a DsiRNAmm possessing mismatched nucleotides at positions 3 and 6, but not at positions 4 and 5, the mismatched residues of sense strand positions 3 and 6 are interspersed by two nucleotides that form matched base pairs with corresponding residues of the antisense strand). For example, two residues of the sense strand (located within the mismatch-tolerant region of the sense strand) that form mismatched base pairs with the corresponding antisense strand sequence can occur with zero, one, two, three, four or five matched base pairs located between these mismatched base pairs.

For certain DsiRNAmm agents possessing three mismatched base pairs, mismatches can occur consecutively (e.g., in a triplet along the sense strand nucleotide sequence). Alternatively, nucleotides of the sense strand that form mismatched base pairs with the antisense strand sequence can be interspersed by nucleotides that form matched base pairs with the antisense strand sequence (e.g., for a DsiRNAmm possessing mismatched nucleotides at positions 3, 4 and 8, but not at positions 5, 6 and 7, the mismatched residues of sense strand positions 3 and 4 are adjacent to one another, while the mismatched residues of sense strand positions 4 and 8 are interspersed by three nucleotides that form matched base pairs with corresponding residues of the antisense strand). For example, three residues of the sense strand (located within the mismatch-tolerant region of the sense strand) that form mismatched base pairs with the corresponding antisense strand sequence can occur with zero, one, two, three or four matched base pairs located between any two of these mismatched base pairs.

For certain DsiRNAmm agents possessing four mismatched base pairs, mismatches can occur consecutively (e.g., in a quadruplet along the sense strand nucleotide sequence). Alternatively, nucleotides of the sense strand that form mismatched base pairs with the antisense strand sequence can be interspersed by nucleotides that form matched base pairs with the antisense strand sequence (e.g., for a DsiRNAmm possessing mismatched nucleotides at positions 3, 5, 7 and 8, but not at positions 4 and 6, the mismatched residues of sense strand positions 7 and 8 are adjacent to one another, while the mismatched residues of sense strand positions 3 and 5 are interspersed by one nucleotide that forms a matched base pair with the corresponding residue of the antisense strand—similarly, the mismatched residues of sense strand positions 5 and 7 are also interspersed by one nucleotide that forms a matched base pair with the corresponding residue of the antisense strand). For example, four residues of the sense strand (located within the mismatch-tolerant region of the sense strand) that form mismatched base pairs with the corresponding antisense strand sequence can occur with zero, one, two or three matched base pairs located between any two of these mismatched base pairs.

In another embodiment, for example with numbering also as depicted in FIG. 1, a DsiRNAmm of the invention comprises a mismatch tolerant region which possesses a single mismatched base pair nucleotide at any one of positions 17, 18, 19, 20, 21, 22 or 23 of the antisense strand of the DsiRNA (where position 1 is the 5' terminal nucleotide of the antisense strand and position 17 is the nucleotide residue of the antisense strand that is immediately 3' (downstream) in the antisense strand of the projected Ago2 cut site of the target AR RNA sequence sufficiently complementary to the antisense strand sequence). In certain embodiments, for a DsiRNAmm that possesses a mismatched base pair nucleotide at any of positions 17, 18, 19, 20, 21, 22 or 23 of the antisense strand with respect to the sense strand of the DsiRNAmm, the mismatched base pair nucleotide of the antisense strand not only forms a mismatched base pair with the DsiRNAmm sense strand sequence, but also forms a mismatched base pair with a DsiRNAmm target AR RNA sequence (thus, complementarity between the antisense strand sequence and the sense strand sequence is disrupted at the mismatched base pair within the DsiRNAmm, and complementarity is similarly disrupted between the antisense strand sequence of the DsiRNAmm and the target AR RNA sequence). In alternative embodiments, the mismatch base pair nucleotide of the antisense strand of a DsiRNAmm only forms a mismatched base pair with a corresponding nucleotide of the sense strand sequence of the DsiRNAmm, yet base pairs with its corresponding target AR RNA sequence nucleotide (thus, complementarity between the antisense strand sequence and the sense strand sequence is disrupted at the mismatched base pair within the DsiRNAmm, yet complementarity is maintained between the antisense strand sequence of the DsiRNAmm and the target AR RNA sequence).

A DsiRNAmm of the invention that possesses a single mismatched base pair within the mismatch-tolerant region as described above (e.g., a DsiRNAmm harboring a mismatched nucleotide residue at positions 17, 18, 19, 20, 21, 22 or 23 of the antisense strand) can further include one, two or even three additional mismatched base pairs. In preferred embodiments, these one, two or three additional mismatched base pairs of the DsiRNAmm occur at position(s) 17, 18, 19, 20, 21, 22 and/or 23 of the antisense strand (and at corresponding residues of the sense strand). In one embodiment where one additional mismatched base pair is present within a DsiRNAmm, the two mismatched base pairs of the antisense strand can occur, e.g., at nucleotides of both position 18 and position 20 of the antisense strand (with mismatch also occurring at corresponding nucleotide residues of the sense strand).

In DsiRNAmm agents possessing two mismatched base pairs, mismatches can occur consecutively (e.g., at consecutive positions along the antisense strand nucleotide sequence). Alternatively, nucleotides of the antisense strand that form mismatched base pairs with the sense strand sequence can be interspersed by nucleotides that base pair with the sense strand sequence (e.g., for a DsiRNAmm possessing mismatched nucleotides at positions 17 and 20, but not at positions 18 and 19, the mismatched residues of antisense strand positions 17 and 20 are interspersed by two nucleotides that form matched base pairs with corresponding residues of the sense strand). For example, two residues of the antisense strand (located within the mismatch-tolerant region of the sense strand) that form mismatched base pairs with the corresponding sense strand sequence can occur with zero, one, two, three, four, five, six or seven matched base pairs located between these mismatched base pairs.

For certain DsiRNAmm agents possessing three mismatched base pairs, mismatches can occur consecutively (e.g., in a triplet along the antisense strand nucleotide sequence). Alternatively, nucleotides of the antisense strand that form mismatched base pairs with the sense strand sequence can be interspersed by nucleotides that form matched base pairs with the sense strand sequence (e.g., for a DsiRNAmm possessing mismatched nucleotides at positions 17, 18 and 22, but not at positions 19, 20 and 21, the mismatched residues of antisense strand positions 17 and 18 are adjacent to one another, while the mismatched residues of antisense strand positions 18 and 122 are interspersed by three nucleotides that form matched base pairs with corresponding residues of the sense strand). For example, three residues of the antisense strand (located within the mismatch-tolerant region of the antisense strand) that form mismatched base pairs with the corresponding sense strand sequence can occur with zero, one, two, three, four, five or six matched base pairs located between any two of these mismatched base pairs.

For certain DsiRNAmm agents possessing four mismatched base pairs, mismatches can occur consecutively (e.g., in a quadruplet along the antisense strand nucleotide sequence). Alternatively, nucleotides of the antisense strand that form mismatched base pairs with the sense strand sequence can be interspersed by nucleotides that form matched base pairs with the sense strand sequence (e.g., for a DsiRNAmm possessing mismatched nucleotides at positions 18, 20, 22 and 23, but not at positions 19 and 21, the mismatched residues of antisense strand positions 22 and 23 are adjacent to one another, while the mismatched residues of antisense strand positions 18 and 20 are interspersed by one nucleotide that forms a matched base pair with the corresponding residue of the sense strand—similarly, the mismatched residues of antisense strand positions 20 and 22 are also interspersed by one nucleotide that forms a matched base pair with the corresponding residue of the sense strand). For example, four residues of the antisense strand (located within the mismatch-tolerant region of the antisense strand) that form mismatched base pairs with the corresponding sense strand sequence can occur with zero, one, two, three, four or five matched base pairs located between any two of these mismatched base pairs.

For reasons of clarity, the location(s) of mismatched nucleotide residues within the above DsiRNAmm agents are numbered in reference to the 5' terminal residue of either sense or antisense strands of the DsiRNAmm The numbering of positions located within the mismatch-tolerant region (mismatch region) of the antisense strand can shift with variations in the proximity of the 5' terminus of the sense or antisense strand to the projected Ago2 cleavage site. Thus, the location(s) of preferred mismatch sites within either antisense strand or sense strand can also be identified as the permissible proximity of such mismatches to the projected Ago2 cut site. Accordingly, in one preferred embodiment, the position of a mismatch nucleotide of the sense strand of a DsiRNAmm is the nucleotide residue of the sense strand that is located immediately 5' (upstream) of the projected Ago2 cleavage site of the corresponding target AR RNA sequence. In other preferred embodiments, a mismatch nucleotide of the sense strand of a DsiRNAmm is positioned at the nucleotide residue of the sense strand that is located two nucleotides 5' (upstream) of the projected Ago2 cleavage site, three nucleotides 5' (upstream) of the projected Ago2 cleavage site, four nucleotides 5' (upstream) of the projected Ago2 cleavage site, five nucleotides 5' (upstream) of the projected Ago2 cleavage site, six nucleotides 5' (upstream) of the projected Ago2 cleavage site, seven nucleotides 5' (upstream) of the projected Ago2 cleavage site, eight nucleotides 5' (upstream) of the projected Ago2 cleavage site, or nine nucleotides 5' (upstream) of the projected Ago2 cleavage site.

Exemplary single mismatch-containing 25/27mer DsiRNAs (DsiRNAmm) include the following structures (such mismatch-containing structures may also be incorporated into other exemplary DsiRNA structures shown herein).

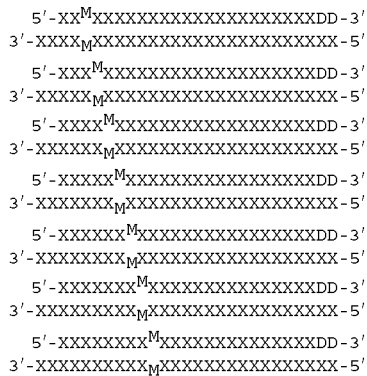

wherein "X"=RNA, "D"=DNA and "M"=Nucleic acid residues (RNA, DNA or non-natural or modified nucleic acids) that do not base pair (hydrogen bond) with corresponding "M" residues of otherwise complementary strand when strands are annealed. Any of the residues of such agents can optionally be 2'-O-methyl RNA monomers—alternating positioning of 2'-O-methyl RNA monomers that commences from the 3'-terminal residue of the bottom (second) strand, as shown above, can also be used in the above DsiRNAmm agents. For the above mismatch structures, the top strand is the sense strand, and the bottom strand is the antisense strand.

In certain embodiments, a DsiRNA of the invention can contain mismatches that exist in reference to the target AR RNA sequence yet do not necessarily exist as mismatched base pairs within the two strands of the DsiRNA—thus, a DsiRNA can possess perfect complementarity between first and second strands of a DsiRNA, yet still possess mismatched residues in reference to a target AR RNA (which, in certain embodiments, may be advantageous in promoting efficacy and/or potency and/or duration of effect). In certain embodiments, where mismatches occur between antisense strand and target AR RNA sequence, the position of a mismatch is located within the antisense strand at a position(s) that corresponds to a sequence of the sense strand located 5' of the projected Ago2 cut site of the target region—e.g., antisense strand residue(s) positioned within the antisense strand to the 3' of the antisense residue which is complementary to the projected Ago2 cut site of the target sequence.

Exemplary 25/27mer DsiRNAs that harbor a single mismatched residue in reference to target sequences include the following structures.

```
Target RNA Sequence:      5'-...AXXXXXXXXXXXXXXXXXXXX...-3'
DsiRNAmm Sense Strand:    5'-XXXXXXXXXXXXXXXXXXXXXXXXXDD-3'
DsiRNAmm Antisense Strand:3'-EXXXXXXXXXXXXXXXXXXXXXXXXXXX-5'

Target RNA Sequence:      5'-...XAXXXXXXXXXXXXXXXXXXX...-3'
DsiRNAmm Sense Strand:    5'-XXXXXXXXXXXXXXXXXXXXXXXXXDD-3'
DsiRNAmm Antisense Strand:3'-XEXXXXXXXXXXXXXXXXXXXXXXXXXX-5'

Target RNA Sequence:      5'-...AXXXXXXXXXXXXXXXXXXX...-3'
DsiRNAmm Sense Strand:    5'-BXXXXXXXXXXXXXXXXXXXXXXXXDD-3'
DsiRNAmm Antisense Strand:3'-XXEXXXXXXXXXXXXXXXXXXXXXXXXX-5'

Target RNA Sequence:      5'-...XAXXXXXXXXXXXXXXXXXX...-3'
DsiRNAmm Sense Strand:    5'-XBXXXXXXXXXXXXXXXXXXXXXXXDD-3'
DsiRNAmm Antisense Strand:3'-XXXEXXXXXXXXXXXXXXXXXXXXXXXX-5'

Target RNA Sequence:      5'-...XXAXXXXXXXXXXXXXXXXX...-3'
DsiRNAmm Sense Strand:    5'-XXBXXXXXXXXXXXXXXXXXXXXXXDD-3'
DsiRNAmm Antisense Strand:3'-XXXXEXXXXXXXXXXXXXXXXXXXXXXX-5'

Target RNA Sequence:      5'-...XXXAXXXXXXXXXXXXXXXX...-3'
DsiRNAmm Sense Strand:    5'-XXXBXXXXXXXXXXXXXXXXXXXXXDD-3'
DsiRNAmm Antisense Strand:3'-XXXXXEXXXXXXXXXXXXXXXXXXXXXX-5'

Target RNA Sequence:      5'-...XXXXAXXXXXXXXXXXXXXX...-3'
DsiRNAmm Sense Strand:    5'-XXXXBXXXXXXXXXXXXXXXXXXXXDD-3'
DsiRNAmm Antisense Strand:3'-XXXXXXEXXXXXXXXXXXXXXXXXXXXX-5'

Target RNA Sequence:      5'-...XXXXXAXXXXXXXXXXXXXX...-3'
DsiRNAmm Sense Strand:    5'-XXXXXBXXXXXXXXXXXXXXXXXXXDD-3'
DsiRNAmm Antisense Strand:3'-XXXXXXXEXXXXXXXXXXXXXXXXXXXX-5'

Target RNA Sequence:      5'-...XXXXXXAXXXXXXXXXXXXX...-3'
DsiRNAmm Sense Strand:    5'-XXXXXXBXXXXXXXXXXXXXXXXXXDD-3'
DsiRNAmm Antisense Strand:3'-XXXXXXXXEXXXXXXXXXXXXXXXXXXX-5'

Target RNA Sequence:      5'-...XXXXXXXAXXXXXXXXXXXX...-3'
DsiRNAmm Sense Strand:    5'-XXXXXXXBXXXXXXXXXXXXXXXXXDD-3'
DsiRNAmm Antisense Strand:3'-XXXXXXXXXEXXXXXXXXXXXXXXXXXX-5'

Target RNA Sequence:      5'-...XXXXXXXXAXXXXXXXXXXX...-3'
DsiRNAmm Sense Strand:    5'-XXXXXXXXBXXXXXXXXXXXXXXXXDD-3'
DsiRNAmm Antisense Strand:3'-XXXXXXXXXXEXXXXXXXXXXXXXXXXX-5'
``` wherein "X"=RNA, "D"=DNA and "E"=Nucleic acid residues (RNA, DNA or non-natural or modified nucleic acids) that do not base pair (hydrogen bond) with corresponding "A" RNA residues of otherwise complementary (target) strand when strands are annealed, yet optionally do base pair with corresponding "B" residues ("B" residues are also RNA, DNA or non-natural or modified nucleic acids). Any of the residues of such agents can optionally be 2'-O-methyl RNA monomers—alternating positioning of 2'-O-methyl RNA monomers that commences from the 3'-terminal residue of the bottom (second) strand, as shown above, can also be used in the above DsiRNA agents.

In addition to the above-exemplified structures, DsiRNAs of the invention can also possess one, two or three additional residues that form further mismatches with the target AR RNA sequence. Such mismatches can be consecutive, or can be interspersed by nucleotides that form matched base pairs with the target AR RNA sequence. Where interspersed by nucleotides that form matched base pairs, mismatched residues can be spaced apart from each other within a single strand at an interval of one, two, three, four, five, six, seven or even eight base paired nucleotides between such mismatch-forming residues.

As for the above-described DsiRNAmm agents, a preferred location within DsiRNAs for antisense strand nucleotides that form mismatched base pairs with target AR RNA sequence (yet may or may not form mismatches with corresponding sense strand nucleotides) is within the antisense strand region that is located 3' (downstream) of the antisense strand sequence which is complementary to the projected Ago2 cut site of the DsiRNA (e.g., in FIG. 1, the region of the antisense strand which is 3' of the projected Ago2 cut site is preferred for mismatch-forming residues and happens to be located at positions 17-23 of the antisense strand for the 25/27mer agent shown in FIG. 1). Thus, in one embodiment, the position of a mismatch nucleotide (in relation to the target AR RNA sequence) of the antisense strand of a DsiRNAmm is the nucleotide residue of the antisense strand that is located immediately 3' (downstream) within the antisense strand sequence of the projected Ago2 cleavage site of the corresponding target AR RNA sequence. In other preferred embodiments, a mismatch nucleotide of the antisense strand of a DsiRNAmm (in relation to the target AR RNA sequence) is positioned at the nucleotide residue of the antisense strand that is located two nucleotides 3' (downstream) of the corresponding projected Ago2 cleavage site, three nucleotides 3' (downstream) of the corresponding projected Ago2 cleavage site, four nucleotides 3' (downstream) of the corresponding projected Ago2 cleavage site, five nucleotides 3' (downstream) of the corresponding projected Ago2 cleavage site, six nucleotides 3' (downstream) of the projected Ago2 cleavage site, seven nucleotides 3' (downstream) of the projected Ago2 cleavage site, eight nucleotides 3' (downstream) of the projected Ago2 cleavage site, or nine nucleotides 3' (downstream) of the projected Ago2 cleavage site.

In DsiRNA agents possessing two mismatch-forming nucleotides of the antisense strand (where mismatch-forming nucleotides are mismatch forming in relation to target AR RNA sequence), mismatches can occur consecutively (e.g., at consecutive positions along the antisense strand nucleotide sequence). Alternatively, nucleotides of the antisense strand that form mismatched base pairs with the target AR RNA sequence can be interspersed by nucleotides that base pair with the target AR RNA sequence (e.g., for a DsiRNA possessing mismatch-forming nucleotides at positions 17 and 20 (starting from the 5' terminus (position 1) of the antisense strand of the 25/27mer agent shown in FIG. 1), but not at positions 18 and 19, the mismatched residues of sense strand positions 17 and 20 are interspersed by two nucleotides that form matched base pairs with corresponding residues of the target AR RNA sequence). For example, two residues of the antisense strand (located within the mismatch-tolerant region of the antisense strand) that form mismatched base pairs with the corresponding target AR RNA sequence can occur with zero, one, two, three, four or five matched base pairs (with respect to target AR RNA sequence) located between these mismatch-forming base pairs.

For certain DsiRNAs possessing three mismatch-forming base pairs (mismatch-forming with respect to target AR RNA sequence), mismatch-forming nucleotides can occur consecutively (e.g., in a triplet along the antisense strand nucleotide sequence). Alternatively, nucleotides of the antisense strand that form mismatched base pairs with the target AR RNA sequence can be interspersed by nucleotides that form matched base pairs with the target AR RNA sequence (e.g., for a DsiRNA possessing mismatched nucleotides at positions 17, 18 and 22, but not at positions 19, 20 and 21, the mismatch-forming residues of antisense strand positions 17 and 18 are adjacent to one another, while the mismatch-forming residues of antisense strand positions 18 and 22 are interspersed by three nucleotides that form matched base pairs with corresponding residues of the target AR RNA). For example, three residues of the antisense strand (located within the mismatch-tolerant region of the antisense strand) that form mismatched base pairs with the corresponding target AR RNA sequence can occur with zero, one, two, three or four matched base pairs located between any two of these mismatch-forming base pairs.

For certain DsiRNAs possessing four mismatch-forming base pairs (mismatch-forming with respect to target AR RNA sequence), mismatch-forming nucleotides can occur consecutively (e.g., in a quadruplet along the sense strand nucleotide sequence). Alternatively, nucleotides of the antisense strand that form mismatched base pairs with the target AR RNA sequence can be interspersed by nucleotides that form matched base pairs with the target AR RNA sequence (e.g., for a DsiRNA possessing mismatch-forming nucleotides at positions 17, 19, 21 and 22, but not at positions 18 and 20, the mismatch-forming residues of antisense strand positions 21 and 22 are adjacent to one another, while the mismatch-forming residues of antisense strand positions 17 and 19 are interspersed by one nucleotide that forms a matched base pair with the corresponding residue of the target AR RNA sequence—similarly, the mismatch-forming residues of antisense strand positions 19 and 21 are also interspersed by one nucleotide that forms a matched base pair with the corresponding residue of the target AR RNA sequence). For example, four residues of the antisense strand (located within the mismatch-tolerant region of the antisense strand) that form mismatched base pairs with the corresponding target AR RNA sequence can occur with zero, one, two or three matched base pairs located between any two of these mismatch-forming base pairs.

The above DsiRNAmm and other DsiRNA structures are described in order to exemplify certain structures of DsiRNAmm and DsiRNA agents. Design of the above DsiRNAmm and DsiRNA structures can be adapted to generate, e.g., DsiRNAmm forms of other DsiRNA structures shown infra. As exemplified above, DsiRNAs can also be designed that possess single mismatches (or two, three or four mismatches) between the antisense strand of the DsiRNA and a target sequence, yet optionally can retain perfect complementarity between sense and antisense strand sequences of a DsiRNA.

It is further noted that the DsiRNA agents exemplified infra can also possess insertion/deletion (in/del) structures within their double-stranded and/or target AR RNA-aligned structures. Accordingly, the DsiRNAs of the invention can be designed to possess in/del variations in, e.g., antisense strand sequence as compared to target AR RNA sequence and/or antisense strand sequence as compared to sense strand sequence, with preferred location(s) for placement of such in/del nucleotides corresponding to those locations described above for positioning of mismatched and/or mismatch-forming base pairs.

It is also noted that the DsiRNAs of the instant invention can tolerate mismatches within the 3'-terminal region of the sense strand/5'-terminal region of the antisense strand, as this region is modeled to be processed by Dicer and liberated from the guide strand sequence that loads into RISC. Exemplary DsiRNA structures of the invention that harbor such mismatches include the following:

```
Target RNA Sequence:    5'-...XXXXXXXXXXXXXXXXXXXXXHXXX...-3'
DsiRNA Sense Strand:    5'-XXXXXXXXXXXXXXXXXXXXXIXDD-3'
DsiRNA Antisense Strand: 3'-XXXXXXXXXXXXXXXXXXXXXXXXJXXX-5'

Target RNA Sequence:    5'-...XXXXXXXXXXXXXXXXXXXXXHXX...-3'
DsiRNA Sense Strand:    5'-XXXXXXXXXXXXXXXXXXXXXIDD-3'
DsiRNA Antisense Strand: 3'-XXXXXXXXXXXXXXXXXXXXXXXXJXX-5'

Target RNA Sequence:    5'-...XXXXXXXXXXXXXXXXXXXXXHX...-3'
DsiRNA Sense Strand:    5'-XXXXXXXXXXXXXXXXXXXXXID-3'
DsiRNA Antisense Strand: 3'-XXXXXXXXXXXXXXXXXXXXXXXXJX-5'

Target RNA Sequence:    5'-...XXXXXXXXXXXXXXXXXXXXXH...-3'
DsiRNA Sense Strand:    5'-XXXXXXXXXXXXXXXXXXXXXDI-3'
DsiRNA Antisense Strand: 3'-XXXXXXXXXXXXXXXXXXXXXXXXJ-5'
``` wherein "X"=RNA, "D"=DNA and "I" and "J"=Nucleic acid residues (RNA, DNA or non-natural or modified nucleic acids) that do not base pair (hydrogen bond) with one another, yet optionally "J" is complementary to target RNA sequence nucleotide "H". Any of the residues of such agents can optionally be 2'-O-methyl RNA monomers—alternating positioning of 2'-O-methyl RNA monomers that commences from the 3'-terminal residue of the bottom (second) strand, as shown above—or any of the above-described methylation patterns—can also be used in the above DsiRNA agents. The above mismatches can also be combined within the DsiRNAs of the instant invention.

In the below structures, such mismatches are introduced within the asymmetric AR-770 DsiRNA (newly-introduced mismatch residues are italicized): AR-770 25/27mer DsiRNA, mismatch position=22 of sense strand (from 5'-terminus)

```
5'-GAAAAAGAUAAUAACUCAGUU^AUta-3'  (SEQ ID NO: 3772)

3'-UUCUUUUUCUAUUAUUGAGUCAA_GAAU-5' (SEQ ID NO: 177)
```

Optionally, the mismatched "A" residue of position 22 of the sense strand is alternatively "U" or "G".

AR-770 25/27mer DsiRNA, mismatch position=23 of sense strand

```
5'-GAAAAAGAUAAUAACUCAGUUC^Gta-3'  (SEQ ID NO: 3773)

3'-UUCUUUUUCUAUUAUUGAGUCAAG_AAU-5' (SEQ ID NO: 177)
```

Optionally, the mismatched "G" residue of position 23 of the sense strand is alternatively "A" or "C".

AR-770 25/27mer DsiRNA, mismatch position=24 of sense strand

```
5'-GAAAAAGAUAAUAACUCAGUUCU^ga-3'  (SEQ ID NO: 3774)

3'-UUCUUUUUCUAUUAUUGAGUCAAGA_AU-5' (SEQ ID NO: 177)
```

Optionally, the mismatched "g" residue of position 24 of the sense strand is alternatively "a" or "c".

AR-770 25/27mer DsiRNA, mismatch position=25 of sense strand

```
5'-GAAAAAGAUAAUAACUCAGUUCUt^c-3'  (SEQ ID NO: 3775)

3'-UUCUUUUUCUAUUAUUGAGUCAAGAA_U-5' (SEQ ID NO: 177)
```

Optionally, the mismatched "c" residue of position 25 of the sense strand is alternatively "t" or "g".

AR-770 25/27mer DsiRNA, mismatch position=1 of antisense strand

```
5'-GAAAAAGAUAAUAACUCAGUUCUt^a-3'  (SEQ ID NO: 24)

3'-UUCUUUUUCUAUUAUUGAGUCAAGAA_G-5' (SEQ ID NO: 3776)
```

Optionally, the mismatched "G" residue of position 1 of the antisense strand is alternatively "A" or "C".

AR-770 25/27mer DsiRNA, mismatch position=2 of antisense strand

```
5'-GAAAAAGAUAAUAACUCAGUUCU^ta-3'  (SEQ ID NO: 24)
3'-UUCUUUUUCUAUUAUUGAGUCAAGA_CU-5' (SEQ ID NO: 3777)
```

Optionally, the mismatched "C" residue of position 2 of the antisense strand is alternatively "G" or "U".

AR-770 25/27mer DsiRNA, mismatch position=3 of antisense strand

```
5'-GAAAAAGAUAAUAACUCAGUUC^Uta-3'  (SEQ ID NO: 24)
3'-UUCUUUUUCUAUUAUUGAGUCAAG_CAU-5' (SEQ ID NO: 3778)
```

Optionally, the mismatched "C" residue of position 3 of the antisense strand is alternatively "U" or "G".

AR-770 25/27mer DsiRNA, mismatch position=4 of antisense strand

```
5'-GAAAAAGAUAAUAACUCAGUU^CUta-3'  (SEQ ID NO: 24)
3'-UUCUUUUUCUAUUAUUGAGUCAA_UAAU-5' (SEQ ID NO: 3779)
```

Optionally, the mismatched "U" residue of position 4 of the antisense strand is alternatively "A" or "C".

As further examples, such mismatches are introduced within the asymmetric AR-2813, AR-2815 and AR-3599 DsiRNAs (newly-introduced mismatch residues are italicized):

AR-2813 25/27mer DsiRNA, mismatch position=22 of sense strand (from 5'-terminus)

```
5'-GACCUGCCUGAUCUGUGGAGA^CGaa-3'   (SEQ ID NO: 5230)
3'-UUCUGGACGGACUAGACACCUCU_ACUU-5' (SEQ ID NO: 1992)
```

Optionally, the mismatched "C" residue of position 22 of the sense strand is alternatively "A" or "G".

AR-2813 25/27mer DsiRNA, mismatch position=23 of sense strand

```
5'-GACCUGCCUGAUCUGUGGAGAU^Aaa-3'   (SEQ ID NO: 5231)
3'-UUCUGGACGGACUAGACACCUCUA_CUU-5' (SEQ ID NO: 1992)
```

Optionally, the mismatched "A" residue of position 23 of the sense strand is alternatively "C" or "U".

AR-2813 25/27mer DsiRNA, mismatch position=24 of sense strand

```
5'-GACCUGCCUGAUCUGUGGAGAUG^Ca-3'   (SEQ ID NO: 5231)
3'-UUCUGGACGGACUAGACACCUCUAC_UU-5' (SEQ ID NO: 1992)
```

Optionally, the mismatched "c" residue of position 24 of the sense strand is alternatively "t" or "g".

AR-2813 25/27mer DsiRNA, mismatch position=25 of sense strand

```
5'-GACCUGCCUGAUCUGUGGAGAUGa^C-3'   (SEQ ID NO: 5233)
3'-UUCUGGACGGACUAGACACCUCUACU_U-5' (SEQ ID NO: 1992)
```

Optionally, the mismatched "c" residue of position 25 of the sense strand is alternatively "t" or "g".

AR-2813 25/27mer DsiRNA, mismatch position=1 of antisense strand

```
5'-GACCUGCCUGAUCUGUGGAGAUGa^a-3'   (SEQ ID NO: 1587)
3'-UUCUGGACGGACUAGACACCUCUACU_C-5' (SEQ ID NO: 5234)
```

Optionally, the mismatched "C" residue of position 1 of the antisense strand is alternatively "A" or "G".

AR-2813 25/27mer DsiRNA, mismatch position=2 of antisense strand

```
5'-GACCUGCCUGAUCUGUGGAGAUG^aa-3'   (SEQ ID NO: 1587)
3'-UUCUGGACGGACUAGACACCUCUAC_CU-5' (SEQ ID NO: 5235)
```

Optionally, the mismatched "C" residue of position 2 of the antisense strand is alternatively "G" or "A".

AR-2813 25/27mer DsiRNA, mismatch position=3 of antisense strand

```
5'-GACCUGCCUGAUCUGUGGAGAU^Gaa-3'   (SEQ ID NO: 1587)
3'-UUCUGGACGGACUAGACACCUCUA_AUU-5' (SEQ ID NO: 5236)
```

Optionally, the mismatched "A" residue of position 3 of the antisense strand is alternatively "U" or "G".

AR-2813 25/27mer DsiRNA, mismatch position=4 of antisense strand

```
5'-GACCUGCCUGAUCUGUGGAGA^UGaa-3'   (SEQ ID NO: 1587)
3'-UUCUGGACGGACUAGACACCUCU_CCUU-5' (SEQ ID NO: 5237)
```

Optionally, the mismatched "C" residue of position 4 of the antisense strand is alternatively "U" or "G".

AR-2815 25/27mer DsiRNA, mismatch position=22 of sense strand (from 5'-terminus)

```
5'-CCUGCCUGAUCUGUGGAGAUG^Agc-3'    (SEQ ID NO: 5238)
3'-CUGGACGGACUAGACACCUCUAC_UUCG-5' (SEQ ID NO: 1994)
```

Optionally, the mismatched "C" residue of position 22 of the sense strand is alternatively "U" or "G".

AR-2815 25/27mer DsiRNA, mismatch position=23 of sense strand

5'-CCUGCCUGAUCUGUGGAGAUGA$^C$gc-3' (SEQ ID NO: 5239)

3'-CUGGACGGACUAGACACCUCUACU$_U$CG-5' (SEQ ID NO: 1994)

Optionally, the mismatched "C" residue of position 23 of the sense strand is alternatively "G" or "U".

AR-2815 25/27mer DsiRNA, mismatch position=24 of sense strand

5'-CCUGCCUGAUCUGUGGAGAUGAA$^a$c-3' (SEQ ID NO: 5240)

3'-CUGGACGGACUAGACACCUCUACUU$_C$G-5' (SEQ ID NO: 1994)

Optionally, the mismatched "a" residue of position 24 of the sense strand is alternatively "t" or "c".

AR-2815 25/27mer DsiRNA, mismatch position=25 of sense strand

5'-CCUGCCUGAUCUGUGGAGAUGAAg$^a$-3' (SEQ ID NO: 5241)

3'-CUGGACGGACUAGACACCUCUACUUC$_G$-5' (SEQ ID NO: 1994)

Optionally, the mismatched "a" residue of position 25 of the sense strand is alternatively "t" or "g".

AR-2815 25/27mer DsiRNA, mismatch position=1 of antisense strand

5'-CCUGCCUGAUCUGUGGAGAUGAAg$^c$-3' (SEQ ID NO: 1589)

3'-CUGGACGGACUAGACACCUCUACUUC$_A$-5' (SEQ ID NO: 5242)

Optionally, the mismatched "A" residue of position 1 of the antisense strand is alternatively "U" or "C".

AR-2815 25/27mer DsiRNA, mismatch position=2 of antisense strand

5'-CCUGCCUGAUCUGUGGAGAUGAA$^g$c-3' (SEQ ID NO: 1589)

3'-CUGGACGGACUAGACACCUCUACUUC$_A$G-5' (SEQ ID NO: 5243)

Optionally, the mismatched "A" residue of position 2 of the antisense strand is alternatively "G" or "U".

AR-2815 25/27mer DsiRNA, mismatch position=3 of antisense strand

5'-CCUGCCUGAUCUGUGGAGAUGA$^A$gc-3' (SEQ ID NO: 1589)
3'-CUGGACGGACUAGACACCUCUACU$_C$CG-5' (SEQ ID NO: 5244)

Optionally, the mismatched "C" residue of position 3 of the antisense strand is alternatively "G" or "A".

AR-2815 25/27mer DsiRNA, mismatch position=4 of antisense strand

5'-CCUGCCUGAUCUGUGGAGAUG$^A$Agc-3' (SEQ ID NO: 1589)
3'-CUGGACGGACUAGACACCUCUAC$_C$UCG-5' (SEQ ID NO: 5245)

Optionally, the mismatched "C" residue of position 4 of the antisense strand is alternatively "G" or "A".

AR-3599 25/27mer DsiRNA, mismatch position=22 of sense strand (from 5'-terminus)

5'-UGGGCUGAAAAAUCAAAAAUU$^A$Utt-3' (SEQ ID NO: 5426)
3'-CUACCCGACUUUUUAGUUUUUAA$_G$AAA-5' (SEQ ID NO: 2159)

Optionally, the mismatched "A" residue of position 22 of the sense strand is alternatively "U" or "G".

AR-3599 25/27mer DsiRNA, mismatch position=23 of sense strand

5'-UGGGCUGAAAAAUCAAAAAUUC$^C$tt-3' (SEQ ID NO: 5247)
3'-CUACCCGACUUUUUAGUUUUUAAG$_A$AA-5' (SEQ ID NO: 2159)

Optionally, the mismatched "C" residue of position 23 of the sense strand is alternatively "G" or "A".

AR-3599 25/27mer DsiRNA, mismatch position=24 of sense strand

5'-UGGGCUGAAAAAUCAAAAAUUCU$^C$t-3' (SEQ ID NO: 5248)
3'-CUACCCGACUUUUUAGUUUUUAAG$_A$AA-5' (SEQ ID NO: 2159)

Optionally, the mismatched "c" residue of position 24 of the sense strand is alternatively "a" or "g".

AR-3599 25/27mer DsiRNA, mismatch position=25 of sense strand

5'-UGGGCUGAAAAAUCAAAAAUUCUt$^C$-3' (SEQ ID NO: 5249)
3'-CUACCCGACUUUUUAGUUUUUAAG$_A$AA-5' (SEQ ID NO: 2159)

Optionally, the mismatched "c" residue of position 25 of the sense strand is alternatively "a" or "g".

AR-3599 25/27mer DsiRNA, mismatch position=1 of antisense strand

5'-UGGGCUGAAAAAUCAAAAAUUCUt$^t$-3' (SEQ ID NO: 1754)
3'-CUACCCGACUUUUUAGUUUUUAAGAA$_C$-5' (SEQ ID NO: 5250)

Optionally, the mismatched "C" residue of position 1 of the antisense strand is alternatively "U" or "G".

AR-3599 25/27mer DsiRNA, mismatch position=2 of antisense strand

5'-UGGGCUGAAAAAUCAAAAAUUCU$^t$t-3' (SEQ ID NO: 1754)
3'-CUACCCGACUUUUUAGUUUUUAAGA$_C$A-5' (SEQ ID NO: 5251)

Optionally, the mismatched "C" residue of position 2 of the antisense strand is alternatively "G" or "U".

AR-3599 25/27mer DsiRNA, mismatch position=3 of antisense strand

```
5'-UGGGCUGAAAAAUCAAAAAUUC^Utt-3'    (SEQ ID NO: 1754)
3'-CUACCCGACUUUUUAGUUUUUAAG_CAA-5'  (SEQ ID NO: 5252)
```

Optionally, the mismatched "C" residue of position 3 of the antisense strand is alternatively "U" or "G".
AR-3599 25/27mer DsiRNA, mismatch position=4 of antisense strand

```
5'-UGGGCUGAAAAAUCAAAAAUU^Ctt-3'     (SEQ ID NO: 1754)
3'-CUACCCGACUUUUUAGUUUUUAA_AAAA-5'  (SEQ ID NO: 5253)
```

Optionally, the mismatched "A" residue of position 4 of the antisense strand is alternatively "U" or "C".

As noted above, introduction of such mismatches can be performed upon any of the DsiRNAs described herein.

The mismatches of such DsiRNA structures can be combined to produce a DsiRNA possessing, e.g., two, three or even four mismatches within the 3'-terminal four nucleotides of the sense strand/5'-terminal four nucleotides of the antisense strand.

Indeed, in view of the flexibility of sequences which can be incorporated into DsiRNAs at the 3'-terminal residues of the sense strand/5'-terminal residues of the antisense strand, in certain embodiments, the sequence requirements of an asymmetric DsiRNA of the instant invention can be represented as the following (minimalist) structure (shown for an exemplary AR-770 DsiRNA sequence):

```
                                  (SEQ ID NO: 3780)
    5'-GAAAAAGAUAAUAACUCAGUUXXX[X]_n-3'
                                  (SEQ ID NO: 3781)
    3'-UUCUUUUUCUAUUAUUGAGUCXXXXX[X]_n-5'
``` where n=1 to 5, 1 to 10, 1 to 20, 1 to 30, 1 to 50, or 1 to 80 or more. AR-770 Target:

```
                                  (SEQ ID NO: 3782)
    5'-AAGAAAAAGATAATAACTCAGXXXXXX-3'
```

The AR target sight may also be a site which is targeted by one or more of several oligonucleotides whose complementary target sites overlap with a stated target site. For example, for an exemplary AR-2813 DsiRNA, it is noted that certain DsiRNAs targeting overlapping and only slightly offset AR sequences can exhibit activity levels similar to that of AR-2808 (specifically, see AR-2815 and AR-2808 DsiRNAs of FIG. 2. Thus, in certain embodiments, a designated target sequence region can be effectively targeted by a series of DsiRNAs possessing largely overlapping sequences. (E.g., if considering DsiRNAs surrounding the AR-2813 site, a more encompassing AR target sequence might be recited as, e.g.,

```
                                  (SEQ ID NO: 3783)
    5'-CCCAGAAGACCTGCCTGATCTGTGGAGATGAAGC-3',
``` wherein any given DsiRNA (e.g., a DsiRNA selected from AR-2808, AR-2809, AR-2810, AR-2811, AR-2812, AR-2813, AR-2814 and AR-2815) only targets a sub-sequence within such a sequence region, yet the entire sequence can be considered a viable target for such a series of DsiRNAs).

Additionally and/or alternatively, mismatches within the 3'-terminal four nucleotides of the sense strand/5'-terminal four nucleotides of the antisense strand can be combined with mismatches positioned at other mismatch-tolerant positions, as described above.

In view of the present identification of the above-described Dicer substrate agents (DsiRNAs) as inhibitors of AR levels via targeting of specific AR sequences, it is also recognized that DsiRNAs having structures similar to those described herein can also be synthesized which target other sequences within the AR sequence of SEQ ID NO: 3766, SEQ ID NO: 3768 or SEQ ID NO: 3770, or within variants thereof (e.g., target sequences possessing 80% identity, 90% identity, 95% identity, 96% identity, 97% identity, 98% identity, 99% or more identity to a sequence of SEQ ID NO: 3766, SEQ ID NO: 3768 and/or SEQ ID NO: 3770).

Anti-AR DsiRNA Design/Synthesis

It has been found empirically that longer dsRNA species of from 25 to 35 nucleotides (DsiRNAs) and especially from 25 to 30 nucleotides give unexpectedly effective results in terms of potency and duration of action, as compared to 19-23mer siRNA agents. Without wishing to be bound by the underlying theory of the dsRNA processing mechanism, it is thought that the longer dsRNA species serve as a substrate for the Dicer enzyme in the cytoplasm of a cell. In addition to cleaving the dsRNA of the invention into shorter segments, Dicer is thought to facilitate the incorporation of a single-stranded cleavage product derived from the cleaved dsRNA into the RISC complex that is responsible for the destruction of the cytoplasmic RNA (e.g., AR RNA) of or derived from the target gene, AR (or other gene associated with an AR-associated disease or disorder). Prior studies (Rossi et al., U.S. Patent Application No. 2007/0265220) have shown that the cleavability of a dsRNA species (specifically, a DsiRNA agent) by Dicer corresponds with increased potency and duration of action of the dsRNA species.

Certain preferred anti-AR DsiRNA agents were selected from a pre-screened population. Design of DsiRNAs can optionally involve use of predictive scoring algorithms that perform in silico assessments of the projected activity/efficacy of a number of possible DsiRNA agents spanning a region of sequence. Information regarding the design of such scoring algorithms can be found, e.g., in Gong et al. (*BMC Bioinformatics* 2006, 7:516), though a more recent "v3" algorithm represents a theoretically improved algorithm relative to siRNA scoring algorithms previously available in the art. (E.g., the "v3" and "v4" scoring algorithms are machine learning algorithms that are not reliant upon any biases in human sequence. In addition, the "v3" and "v4" algorithms derive from data sets that are many-fold larger than that from which an older "v2" algorithm such as that described in Gong et al. derives.)

The first and second oligonucleotides of the DsiRNA agents of the instant invention are not required to be completely complementary. In fact, in one embodiment, the 3'-terminus of the sense strand contains one or more mismatches. In one aspect, two mismatches are incorporated at the 3' terminus of the sense strand. In another embodiment, the DsiRNA of the invention is a double stranded RNA molecule containing two RNA oligonucleotides each of which is 27 nucleotides in length and, when annealed to each other, have blunt ends and a two nucleotide mismatch on the 3'-terminus of the sense strand (the 5'-terminus of the antisense strand). The use of mismatches or decreased thermodynamic stability (specifically at the 3'-sense/5'-antisense position) has been proposed to facilitate or favor entry of the antisense strand into RISC (Schwarz et al., 2003, *Cell* 115: 199-208;

Khvorova et al., 2003, *Cell* 115: 209-216), presumably by affecting some rate-limiting unwinding steps that occur with entry of the siRNA into RISC. Thus, terminal base composition has been included in design algorithms for selecting active 21mer siRNA duplexes (Ui-Tei et al., 2004, *Nucleic Acids Res* 32: 936-948; Reynolds et al., 2004, *Nat Biotechnol* 22: 326-330). With Dicer cleavage of the dsRNA of this embodiment, the small end-terminal sequence which contains the mismatches will either be left unpaired with the antisense strand (become part of a 3'-overhang) or be cleaved entirely off the final 21-mer siRNA. These "mismatches", therefore, do not persist as mismatches in the final RNA component of RISC. The finding that base mismatches or destabilization of segments at the 3'-end of the sense strand of Dicer substrate improved the potency of synthetic duplexes in RNAi, presumably by facilitating processing by Dicer, was a surprising finding of past works describing the design and use of 25-30mer dsRNAs (also termed "DsiRNAs" herein; Rossi et al., U.S. Patent Application Nos. 2005/0277610, 2005/0244858 and 2007/0265220).

Modification of Anti-AR DsiRNAs

One major factor that inhibits the effect of double stranded RNAs ("dsRNAs") is the degradation of dsRNAs (e.g., siRNAs and DsiRNAs) by nucleases. A 3'-exonuclease is the primary nuclease activity present in serum and modification of the 3'-ends of antisense DNA oligonucleotides is crucial to prevent degradation (Eder et al., 1991, *Antisense Res Dev,* 1: 141-151). An RNase-T family nuclease has been identified called ERI-1 which has 3' to 5' exonuclease activity that is involved in regulation and degradation of siRNAs (Kennedy et al., 2004, *Nature* 427: 645-649; Hong et al., 2005, *Biochem J,* 390: 675-679). This gene is also known as Thexl (NM_02067) in mice or THEX1 (NM_153332) in humans and is involved in degradation of histone mRNA; it also mediates degradation of 3'-overhangs in siRNAs, but does not degrade duplex RNA (Yang et al., 2006, *J Biol Chem,* 281: 30447-30454). It is therefore reasonable to expect that 3'-end-stabilization of dsRNAs, including the DsiRNAs of the instant invention, will improve stability.

XRN1 (NM_019001) is a 5' to 3' exonuclease that resides in P-bodies and has been implicated in degradation of mRNA targeted by miRNA (Rehwinkel et al., 2005, *RNA* 11: 1640-1647) and may also be responsible for completing degradation initiated by internal cleavage as directed by a siRNA. XRN2 (NM_012255) is a distinct 5' to 3' exonuclease that is involved in nuclear RNA processing.

RNase A is a major endonuclease activity in mammals that degrades RNAs. It is specific for ssRNA and cleaves at the 3'-end of pyrimidine bases. SiRNA degradation products consistent with RNase A cleavage can be detected by mass spectrometry after incubation in serum (Turner et al., 2007, *Mol Biosyst* 3: 43-50).

The 3'-overhangs enhance the susceptibility of siRNAs to RNase degradation. Depletion of RNase A from serum reduces degradation of siRNAs; this degradation does show some sequence preference and is worse for sequences having poly A/U sequence on the ends (Haupenthal et al., 2006 *Biochem Pharmacol* 71: 702-710). This suggests the possibility that lower stability regions of the duplex may "breathe" and offer transient single-stranded species available for degradation by RNase A. RNase A inhibitors can be added to serum and improve siRNA longevity and potency (Haupenthal et al., 2007, *Int J. Cancer* 121: 206-210).

In 21mers, phosphorothioate or boranophosphate modifications directly stabilize the internucleoside phosphate linkage. Boranophosphate modified RNAs are highly nuclease resistant, potent as silencing agents, and are relatively non-toxic. Boranophosphate modified RNAs cannot be manufactured using standard chemical synthesis methods and instead are made by in vitro transcription (IVT) (Hall et al., 2004, *Nucleic Acids Res* 32: 5991-6000; Hall et al., 2006, *Nucleic Acids Res* 34: 2773-2781). Phosphorothioate (PS) modifications can be easily placed in the RNA duplex at any desired position and can be made using standard chemical synthesis methods. The PS modification shows dose-dependent toxicity, so most investigators have recommended limited incorporation in siRNAs, favoring the 3'-ends where protection from nucleases is most important (Harborth et al., 2003, *Antisense Nucleic Acid Drug Dev* 13: 83-105; Chiu and Rana, 2003, *Mol Cell* 10: 549-561; Braasch et al., 2003, *Biochemistry* 42: 7967-7975; Amarzguioui et al., 2003, *Nucleic Acids Research* 31: 589-595). More extensive PS modification can be compatible with potent RNAi activity; however, use of sugar modifications (such as 2'-O-methyl RNA) may be superior (Choung et al., 2006, *Biochem Biophys Res Commun* 342: 919-927).

A variety of substitutions can be placed at the 2'-position of the ribose which generally increases duplex stability ($T_m$) and can greatly improve nuclease resistance. 2'-O-methyl RNA is a naturally occurring modification found in mammalian ribosomal RNAs and transfer RNAs. 2'-O-methyl modification in siRNAs is known, but the precise position of modified bases within the duplex is important to retain potency and complete substitution of 2'-O-methyl RNA for RNA will inactivate the siRNA. For example, a pattern that employs alternating 2'-O-methyl bases can have potency equivalent to unmodified RNA and is quite stable in serum (Choung et al., 2006, *Biochem Biophys Res Commun* 342: 919-927; Czauderna et al., 2003, *Nucleic Acids Research* 31: 2705-2716).

The 2'-fluoro (2'-F) modification is also compatible with dsRNA (e.g., siRNA and DsiRNA) function; it is most commonly placed at pyrimidine sites (due to reagent cost and availability) and can be combined with 2'-O-methyl modification at purine positions; 2'-F purines are available and can also be used. Heavily modified duplexes of this kind can be potent triggers of RNAi in vitro (Allerson et al., 2005, *J Med Chem* 48: 901-904; Prakash et al., 2005, *J Med Chem* 48: 4247-4253; Kraynack and Baker, 2006, *RNA* 12: 163-176) and can improve performance and extend duration of action when used in vivo (Morrissey et al., 2005, *Hepatology* 41: 1349-1356; Morrissey et al., 2005, *Nat Biotechnol* 23: 1002-1007). A highly potent, nuclease stable, blunt 19mer duplex containing alternative 2'-F and 2'-O-Me bases is taught by Allerson. In this design, alternating 2'-O-Me residues are positioned in an identical pattern to that employed by Czauderna, however the remaining RNA residues are converted to 2'-F modified bases. A highly potent, nuclease resistant siRNA employed by Morrissey employed a highly potent, nuclease resistant siRNA in vivo. In addition to 2'-O-Me RNA and 2'-F RNA, this duplex includes DNA, RNA, inverted abasic residues, and a 3'-terminal PS internucleoside linkage. While extensive modification has certain benefits, more limited modification of the duplex can also improve in vivo performance and is both simpler and less costly to manufacture. Soutschek et al. (2004, *Nature* 432: 173-178) employed a duplex in vivo and was mostly RNA with two 2'-O-Me RNA bases and limited 3'-terminal PS internucleoside linkages.

Locked nucleic acids (LNAs) are a different class of 2'-modification that can be used to stabilize dsRNA (e.g., siRNA and DsiRNA). Patterns of LNA incorporation that retain potency are more restricted than 2'-O-methyl or 2'-F bases, so limited modification is preferred (Braasch et al., 2003, *Biochemistry* 42: 7967-7975; Grunweller et al., 2003, *Nucleic Acids Res* 31: 3185-3193; Elmen et al., 2005, *Nucleic*

Acids Res 33: 439-447). Even with limited incorporation, the use of LNA modifications can improve dsRNA performance in vivo and may also alter or improve off target effect profiles (Mook et al., 2007, Mol Cancer Ther 6: 833-843).

Synthetic nucleic acids introduced into cells or live animals can be recognized as "foreign" and trigger an immune response Immune stimulation constitutes a major class of off-target effects which can dramatically change experimental results and even lead to cell death. The innate immune system includes a collection of receptor molecules that specifically interact with DNA and RNA that mediate these responses, some of which are located in the cytoplasm and some of which reside in endosomes (Marques and Williams, 2005, Nat Biotechnol 23: 1399-1405; Schlee et al., 2006, Mol Ther 14: 463-470). Delivery of siRNAs by cationic lipids or liposomes exposes the siRNA to both cytoplasmic and endosomal compartments, maximizing the risk for triggering a type 1 interferon (IFN) response both in vitro and in vivo (Morrissey et al., 2005, Nat Biotechnol 23: 1002-1007; Sioud and Sorensen, 2003, Biochem Biophys Res Commun 312: 1220-1225; Sioud, 2005, J Mol Biol 348: 1079-1090; Ma et al., 2005, Biochem Biophys Res Commun 330: 755-759). RNAs transcribed within the cell are less immunogenic (Robbins et al., 2006, Nat Biotechnol 24: 566-571) and synthetic RNAs that are immunogenic when delivered using lipid-based methods can evade immune stimulation when introduced unto cells by mechanical means, even in vivo (Heidel et al., 2004, Nat Biotechnol 22: 1579-1582). However, lipid based delivery methods are convenient, effective, and widely used. Some general strategy to prevent immune responses is needed, especially for in vivo application where all cell types are present and the risk of generating an immune response is highest. Use of chemically modified RNAs may solve most or even all of these problems.

In certain embodiments, modifications can be included in the anti-AR DsiRNA agents of the present invention so long as the modification does not prevent the DsiRNA agent from possessing AR inhibitory activity. In one embodiment, one or more modifications are made that enhance Dicer processing of the DsiRNA agent (an assay for determining Dicer processing of a DsiRNA is described supra). In a second embodiment, one or more modifications are made that result in more effective AR inhibition (as described herein, AR inhibition/ AR inhibitory activity of a DsiRNA can be assayed via art-recognized methods for determining RNA levels, or for determining AR polypeptide levels, should such levels be assessed in lieu of or in addition to assessment of, e.g., AR mRNA levels). In a third embodiment, one or more modifications are made that support greater AR inhibitory activity (means of determining AR inhibitory activity are described supra). In a fourth embodiment, one or more modifications are made that result in greater potency of AR inhibitory activity per each DsiRNA agent molecule to be delivered to the cell (potency of AR inhibitory activity is described supra). Modifications can be incorporated in the 3'-terminal region, the 5'-terminal region, in both the 3'-terminal and 5'-terminal region or in some instances in various positions within the sequence. With the restrictions noted above in mind, numbers and combinations of modifications can be incorporated into the DsiRNA agent. Where multiple modifications are present, they may be the same or different. Modifications to bases, sugar moieties, the phosphate backbone, and their combinations are contemplated. Either 5'-terminus can be phosphorylated.

Examples of modifications contemplated for the phosphate backbone include phosphonates, including methylphosphonate, phosphorothioate, and phosphotriester modifications such as alkylphosphotriesters, and the like. Examples of modifications contemplated for the sugar moiety include 2'-alkyl pyrimidine, such as 2'-O-methyl, 2'-fluoro, amino, and deoxy modifications and the like (see, e.g., Amarzguioui et al., 2003, Nucleic Acids Research 31: 589-595). Examples of modifications contemplated for the base groups include abasic sugars, 2-O-alkyl modified pyrimidines, 4-thiouracil, 5-bromouracil, 5-iodouracil, and 5-(3-aminoallyl)-uracil and the like. Locked nucleic acids, or LNA's, could also be incorporated. Many other modifications are known and can be used so long as the above criteria are satisfied. Examples of modifications are also disclosed in U.S. Pat. Nos. 5,684,143, 5,858, 988 and 6,291,438 and in U.S. published patent application No. 2004/0203145 A1. Other modifications are disclosed in Herdewijn (2000, Antisense Nucleic Acid Drug Dev 10: 297-310), Eckstein (2000, Antisense Nucleic Acid Drug Dev 10: 117-21), Rusckowski et al. (2000, Antisense Nucleic Acid Drug Dev 10: 333-345), Stein et al. (2001, Antisense Nucleic Acid Drug Dev 11: 317-25); Vorobjev et al. (2001, Antisense Nucleic Acid Drug Dev 11: 77-85).

One or more modifications contemplated can be incorporated into either strand. The placement of the modifications in the DsiRNA agent can greatly affect the characteristics of the DsiRNA agent, including conferring greater potency and stability, reducing toxicity, enhance Dicer processing, and minimizing an immune response. In one embodiment, the antisense strand or the sense strand or both strands have one or more 2'-O-methyl modified nucleotides. In another embodiment, the antisense strand contains 2'-O-methyl modified nucleotides. In another embodiment, the antisense stand contains a 3' overhang that is comprised of 2'-O-methyl modified nucleotides. The antisense strand could also include additional 2'-O-methyl modified nucleotides.

In certain embodiments of the present invention, the anti-AR DsiRNA agent has one or more of the following properties: (i) the DsiRNA agent is asymmetric, e.g., has a 3' overhang on the antisense strand and (ii) the DsiRNA agent has a modified 3' end on the sense strand to direct orientation of Dicer binding and processing of the dsRNA to an active siRNA. According to this embodiment, the longest strand in the dsRNA comprises 25-35 nucleotides (e.g., 25, 26, 27, 28, 29, 30, 31, 32, 33, 34 or 35 nucleotides). In certain such embodiments, the DsiRNA agent is asymmetric such that the sense strand comprises 25-34 nucleotides and the 3' end of the sense strand forms a blunt end with the 5' end of the antisense strand while the antisense strand comprises 26-35 nucleotides and forms an overhang on the 3' end of the antisense strand. In one embodiment, the DsiRNA agent is asymmetric such that the sense strand comprises 25-28 nucleotides and the antisense strand comprises 25-30 nucleotides. Thus, the resulting dsRNA has an overhang on the 3' end of the antisense strand. The overhang is 1-4 nucleotides, for example 2 nucleotides. The sense strand may also have a 5' phosphate.

In other embodiments, the sense strand of the DsiRNA agent is modified for Dicer processing by suitable modifiers located at the 3' end of the sense strand, i.e., the DsiRNA agent is designed to direct orientation of Dicer binding and processing. Suitable modifiers include nucleotides such as deoxyribonucleotides, dideoxyribonucleotides, acyclonucleotides and the like and sterically hindered molecules, such as fluorescent molecules and the like. Acyclonucleotides substitute a 2-hydroxyethoxymethyl group for the 2'-deoxyribofuranosyl sugar normally present in dNMPs. Other nucleotides modifiers could include 3'-deoxyadenosine (cordycepin), 3'-azido-3'-deoxythymidine (AZT), 2',3'-dideoxyinosine (ddI), 2',3'-dideoxy-3'-thiacytidine (3TC), 2',3'-didehydro-2',3'-dideoxythymidine (d4T) and the monophosphate nucleotides of 3'-azido-3'-deoxythymidine (AZT), 2',3'-dideoxy-3'-thiacytidine (3TC) and 2',3'-didehydro-2',3'-dideoxythymidine (d4T). In one embodiment, deoxynucleotides are used as the modifiers. When nucleotide modifiers are utilized, 1-3 nucleotide modifiers, or 2 nucleotide modifiers are substituted for the ribonucleotides on the 3' end of the sense strand. When sterically hindered molecules are utilized, they are attached to the ribonucleotide at the 3' end of the antisense strand. Thus, the length of the strand does not change with the incorporation of the modifiers. In another embodiment, the invention contemplates substituting two DNA bases in the DsiRNA agent to direct the orientation of Dicer processing of the antisense strand. In a further embodiment of the present invention, two terminal DNA bases are substituted for two ribonucleotides on the 3'-end of the sense strand forming a blunt end of the duplex on the 3' end of the sense strand and the 5' end of the antisense strand, and a two-nucleotide RNA overhang is located on the 3'-end of the antisense strand. This is an asymmetric composition with DNA on the blunt end and RNA bases on the overhanging end.

The sense and antisense strands of a DsiRNA agent of the instant invention anneal under biological conditions, such as the conditions found in the cytoplasm of a cell. In addition, a region of one of the sequences, particularly of the antisense strand, of the DsiRNA agent has a sequence length of at least 15 (in certain embodiments, 19) nucleotides, wherein these nucleotides are adjacent to the 3' end of antisense strand (e.g., in the 21-nucleotide region adjacent to the 3' end of the antisense strand and are sufficiently complementary to a nucleotide sequence of the target AR RNA.

Additionally, the DsiRNA agent structure can be optimized to ensure that the oligonucleotide segment generated from Dicer's cleavage will be the portion of the oligonucleotide that is most effective in inhibiting gene expression. For example, in one embodiment of the invention, a 27-bp oligonucleotide of the DsiRNA agent structure is synthesized wherein the anticipated 21 to 22-bp segment that will inhibit gene expression is located on the 3'-end of the antisense strand. The remaining bases located on the 5'-end of the antisense strand will be cleaved by Dicer and will be discarded. This cleaved portion can be homologous (i.e., based on the sequence of the target sequence) or non-homologous and added to extend the nucleic acid strand.

The DsiRNA agent can also have one or more of the following additional properties: (a) the antisense strand has a right shift from the typical 21mer (e.g., the DsiRNA comprises a length of antisense strand nucleotides that extends to the 5' of a projected Dicer cleavage site within the DsiRNA, with such antisense strand nucleotides base paired with corresponding nucleotides of the sense strand extending 3' of a projected Dicer cleavage site in the sense strand), (b) the strands may not be completely complementary, i.e., the strands may contain simple mismatched base pairs (in certain embodiments, the DsiRNAs of the invention possess 1, 2, 3, 4 or even 5 or more mismatched base pairs, provided that AR inhibitory activity of the DsiRNA possessing mismatched base pairs is retained at sufficient levels (e.g., retains at least 50% AR inhibitory activity or more, at least 60% AR inhibitory activity or more, at least 70% AR inhibitory activity or more, at least 80% AR inhibitory activity or more, at least 90% AR inhibitory activity or more or at least 95% AR inhibitory activity or more as compared to a corresponding DsiRNA not possessing mismatched base pairs. In certain embodiments, mismatched base pairs exist between the antisense and sense strands of a DsiRNA. In some embodiments, mismatched base pairs exist (or are predicted to exist) between the antisense strand and the target RNA. In certain embodiments, the presence of a mismatched base pair(s) between an antisense strand residue and a corresponding residue within the target RNA that is located 3' in the target RNA sequence of a projected Ago2 cleavage site retains and may even enhance AR inhibitory activity of a DsiRNA of the invention) and (c) base modifications such as locked nucleic acid(s) may be included in the 5' end of the sense strand. A "typical" 21mer siRNA is designed using conventional techniques. In one technique, a variety of sites are commonly tested in parallel or pools containing several distinct siRNA duplexes specific to the same target with the hope that one of the reagents will be effective (Ji et al., 2003, FEBS Lett 552: 247-252). Other techniques use design rules and algorithms to increase the likelihood of obtaining active RNAi effector molecules (Schwarz et al., 2003, *Cell* 115: 199-208; Khvorova et al., 2003, *Cell* 115: 209-216; Ui-Tei et al., 2004, *Nucleic Acids Res* 32: 936-948; Reynolds et al., 2004, *Nat Biotechnol* 22: 326-330; Krol et al., 2004, *J Biol Chem* 279: 42230-42239; Yuan et al., 2004, *Nucl Acids Res* 32(Webserver issue):W130-134; Boese et al., 2005, *Methods Enzymol* 392: 73-96). High throughput selection of siRNA has also been developed (U.S. published patent application No. 2005/0042641 A1). Potential target sites can also be analyzed by secondary structure predictions (Heale et al., 2005, *Nucleic Acids Res* 33(3): e30). This 21mer is then used to design a right shift to include 3-9 additional nucleotides on the 5' end of the 21mer. The sequence of these additional nucleotides is not restricted. In one embodiment, the added ribonucleotides are based on the sequence of the target gene. Even in this embodiment, full complementarity between the target sequence and the antisense siRNA is not required.

The first and second oligonucleotides of a DsiRNA agent of the instant invention are not required to be completely complementary. They only need to be sufficiently complementary to anneal under biological conditions and to provide a substrate for Dicer that produces a siRNA sufficiently complementary to the target sequence. Locked nucleic acids, or LNA's, are well known to a skilled artisan (Elmen et al., 2005, *Nucleic Acids Res* 33: 439-447; Kurreck et al., 2002, *Nucleic Acids Res* 30: 1911-1918; Crinelli et al., 2002, *Nucleic Acids Res* 30: 2435-2443; Braasch and Corey, 2001, *Chem Biol* 8: 1-7; Bondensgaard et al., 2000, *Chemistry* 6: 2687-2695; Wahlestedt et al., 2000, *Proc Natl Acad Sci USA* 97: 5633-5638). In one embodiment, an LNA is incorporated at the 5' terminus of the sense strand. In another embodiment, an LNA is incorporated at the 5' terminus of the sense strand in duplexes designed to include a 3' overhang on the antisense strand.

In certain embodiments, the DsiRNA agent of the instant invention has an asymmetric structure, with the sense strand having a 25-base pair length, and the antisense strand having a 27-base pair length with a 2 base 3'-overhang. In other embodiments, this DsiRNA agent having an asymmetric structure further contains 2 deoxynucleotides at the 3' end of the sense strand in place of two of the ribonucleotides.

Certain DsiRNA agent compositions containing two separate oligonucleotides can be linked by a third structure. The third structure will not block Dicer activity on the DsiRNA agent and will not interfere with the directed destruction of the RNA transcribed from the target gene. In one embodiment, the third structure may be a chemical linking group. Many suitable chemical linking groups are known in the art and can be used. Alternatively, the third structure may be an oligonucleotide that links the two oligonucleotides of the DsiRNA agent in a manner such that a hairpin structure is produced upon annealing of the two oligonucleotides making up the dsRNA composition. The hairpin structure will not block Dicer activity on the DsiRNA agent and will not interfere with the directed destruction of the AR RNA.

In certain embodiments, the anti-AR DsiRNA agent of the invention has several properties which enhance its processing by Dicer. According to such embodiments, the DsiRNA agent has a length sufficient such that it is processed by Dicer to produce an siRNA and at least one of the following properties: (i) the DsiRNA agent is asymmetric, e.g., has a 3' overhang on the sense strand and (ii) the DsiRNA agent has a modified 3' end on the antisense strand to direct orientation of Dicer binding and processing of the dsRNA to an active siRNA. According to these embodiments, the longest strand in the DsiRNA agent comprises 25-30 nucleotides. In one embodiment, the sense strand comprises 25-30 nucleotides and the antisense strand comprises 25-28 nucleotides. Thus, the resulting dsRNA has an overhang on the 3' end of the sense strand. The overhang is 1-4 nucleotides, such as 2 nucleotides. The antisense strand may also have a 5' phosphate.

In certain embodiments, the sense strand of a DsiRNA agent is modified for Dicer processing by suitable modifiers located at the 3' end of the sense strand, i.e., the DsiRNA agent is designed to direct orientation of Dicer binding and processing. Suitable modifiers include nucleotides such as deoxyribonucleotides, dideoxyribonucleotides, acyclonucleotides and the like and sterically hindered molecules, such as fluorescent molecules and the like. Acyclonucleotides substitute a 2-hydroxyethoxymethyl group for the 2'-deoxyribofuranosyl sugar normally present in dNMPs. Other nucleotide modifiers could include 3'-deoxyadenosine (cordycepin), 3'-azido-3'-deoxythymidine (AZT), 2',3'-dideoxyinosine (ddI), 2',3'-dideoxy-3'-thiacytidine (3TC), 2',3'-didehydro-2',3'-dideoxythymidine (d4T) and the monophosphate nucleotides of 3'-azido-3'-deoxythymidine (AZT), 2',3'-dideoxy-3'-thiacytidine (3TC) and 2',3'-didehydro-2',3'-dideoxythymidine (d4T). In one embodiment, deoxynucleotides are used as the modifiers. When nucleotide modifiers are utilized, 1-3 nucleotide modifiers, or 2 nucleotide modifiers are substituted for the ribonucleotides on the 3' end of the sense strand. When sterically hindered molecules are utilized, they are attached to the ribonucleotide at the 3' end of the antisense strand. Thus, the length of the strand does not change with the incorporation of the modifiers. In another embodiment, the invention contemplates substituting two DNA bases in the dsRNA to direct the orientation of Dicer processing. In a further invention, two terminal DNA bases are located on the 3' end of the antisense strand in place of two ribonucleotides forming a blunt end of the duplex on the 5' end of the sense strand and the 3' end of the antisense strand, and a two-nucleotide RNA overhang is located on the 3'-end of the sense strand. This is an asymmetric composition with DNA on the blunt end and RNA bases on the overhanging end.

In certain other embodiments, the antisense strand of a DsiRNA agent is modified for Dicer processing by suitable modifiers located at the 3' end of the antisense strand, i.e., the DsiRNA agent is designed to direct orientation of Dicer binding and processing. Suitable modifiers include nucleotides such as deoxyribonucleotides, dideoxyribonucleotides, acyclonucleotides and the like and sterically hindered molecules, such as fluorescent molecules and the like. Acyclonucleotides substitute a 2-hydroxyethoxymethyl group for the 2'-deoxyribofuranosyl sugar normally present in dNMPs. Other nucleotide modifiers could include 3'-deoxyadenosine (cordycepin), 3'-azido-3'-deoxythymidine (AZT), 2',3'-dideoxyinosine (ddI), 2',3'-dideoxy-3'-thiacytidine (3TC), 2',3'-didehydro-2',3'-dideoxythymidine (d4T) and the monophosphate nucleotides of 3'-azido-3'-deoxythymidine (AZT), 2',3'-dideoxy-3'-thiacytidine (3TC) and 2',3'-didehydro-2',3'-dideoxythymidine (d4T). In one embodiment, deoxynucleotides are used as the modifiers. When nucleotide modifiers are utilized, 1-3 nucleotide modifiers, or 2 nucleotide modifiers are substituted for the ribonucleotides on the 3' end of the antisense strand. When sterically hindered molecules are utilized, they are attached to the ribonucleotide at the 3' end of the antisense strand. Thus, the length of the strand does not change with the incorporation of the modifiers. In another embodiment, the invention contemplates substituting two DNA bases in the dsRNA to direct the orientation of Dicer processing. In a further invention, two terminal DNA bases are located on the 3' end of the antisense strand in place of two ribonucleotides forming a blunt end of the duplex on the 5' end of the sense strand and the 3' end of the antisense strand, and a two-nucleotide RNA overhang is located on the 3'-end of the sense strand. This is also an asymmetric composition with DNA on the blunt end and RNA bases on the overhanging end.

The sense and antisense strands anneal under biological conditions, such as the conditions found in the cytoplasm of a cell. In addition, a region of one of the sequences, particularly of the antisense strand, of the dsRNA has a sequence length of at least 19 nucleotides, wherein these nucleotides are adjacent to the 3' end of antisense strand and are sufficiently complementary to a nucleotide sequence of the target AR RNA.

Additionally, the DsiRNA agent structure can be optimized to ensure that the oligonucleotide segment generated from Dicer's cleavage will be the portion of the oligonucleotide that is most effective in inhibiting gene expression. For example, in one embodiment of the invention, a 27-bp oligonucleotide of the DsiRNA agent structure is synthesized wherein the anticipated 21 to 22-bp segment that will inhibit gene expression is located on the 3'-end of the antisense strand. The remaining bases located on the 5'-end of the antisense strand will be cleaved by Dicer and will be discarded. This cleaved portion can be homologous (i.e., based on the sequence of the target sequence) or non-homologous and added to extend the nucleic acid strand.

US 2007/0265220 discloses that 27mer DsiRNAs show improved stability in serum over comparable 21mer siRNA compositions, even absent chemical modification. Modifications of DsiRNA agents, such as inclusion of 2'-O-methyl RNA in the antisense strand, in patterns such as detailed above, when coupled with addition of a 5' Phosphate, can improve stability of DsiRNA agents. Addition of 5'-phosphate to all strands in synthetic RNA duplexes may be an inexpensive and physiological method to confer some limited degree of nuclease stability.

The chemical modification patterns of the dsRNA agents of the instant invention are designed to enhance the efficacy of such agents. Accordingly, such modifications are designed to avoid reducing potency of dsRNA agents; to avoid interfering with Dicer processing of DsiRNA agents; to improve stability in biological fluids (reduce nuclease sensitivity) of dsRNA agents; or to block or evade detection by the innate immune system. Such modifications are also designed to avoid being toxic and to avoid increasing the cost or impact the ease of manufacturing the instant dsRNA agents of the invention.

AR Biology and Biochemistry

AR, also known as NR3C4 (nuclear receptor subfamily 3, group C, member 4), is a nuclear receptor (Wardell et al., *Pharmacol. Rev.* 58 (4): 782-97) that is activated by cytoplasmic binding of androgenic hormones (testosterone or dihydrotestosterone; Roy et al., *Vitam. Horm.* 55: 309-52), resulting in nuclear translocation of AR. Among nuclear receptors, AR is most closely related to the progesterone receptor, and progestins in higher dosages have been shown to block AR (Bardin et al., *Pharmacol. Ther.* 23 (3): 443-59; Raudrant and Rabe, *Drugs* 63 (5): 463-92). Androgen regulated genes are critical for the development and maintenance of the male sexual phenotype.

Two isoforms of the androgen receptor (A and B) have been identified (Wilson and McPhaul, *Proc. Natl. Acad. Sci. U.S.A.* 91 (4): 1234-8). AR-B is a 110 kDa full length form, while AR-A is an 87 kDa protein that results from in vitro proteolysis of the N-terminus of the full length form (accordingly, AR-A lacks the first 187 amino acids of the full length form, AR-B; Gregory et al. *J Mol Endocrinol* 27: 309-19).

Like other nuclear receptors, the androgen receptor is modular in structure and, from the N-terminus to the C-terminus, is composed of the following functional domains:

An N-terminal regulatory domain contains: activation function 1 (AF-1) between residues 101 and 370, required for full ligand activated transcriptional activity (Jenster et al., *J. Biol. Chem.* 270: 7341-6); activation function 5 (AF-5) between residues 360-485, which is responsible for constitutive activity (activity without bound ligand); a dimerization surface involving residues 1-36 (containing an FXXLF motif where F=phenylalanine, L=leucine, and X=any amino acid residue) and 370-494, which both interact with the LBD in an intramolecular (Schaufele et al. *Proc. Natl. Acad. Sci. U.S.A.* 102: 9802-7; Klokk et al. *Mol. Cell. Biol.* 27 (5): 1823-43; van Royen et al. *J. Cell Biol.* 177 (1): 63-72) head-to-tail interaction (Langley et al. *J. Biol. Chem.* 270 (50): 29983-90; Berrevoets et al. *Mol. Endocrinol.* 12 (8): 1172-83; Dubbink et al. *Mol. Endocrinol.* 18 (9): 2132-50);

a DNA binding domain (DBD);

a hinge region, which is a flexible region that connects the DBD with the LBD; along with the DBD, this region contains a ligand dependent nuclear localization signal (Kahl et al. *Endocrinology* 149: 3960);

a ligand binding domain (LBD) containing: activation function 2 (AF-2), responsible for agonist induced activity (activity in the presence of bound agonist); AF-2, which binds either the N-terminal FXXFL motif intramolecularly or coactivator proteins (containing the LXXLL or preferably FXXFL motifs; Dubbink et al. *Mol. Endocrinol.* 18 (9): 2132-50); and a ligand dependent nuclear export signal (Saporita et al. *J. Biol. Chem.* 278 (43): 41998-2005); and a C-terminal domain.

Known human and mouse AR cDNA and polypeptide sequences include the following:

```
Human Wild-type AR sequence, long transcript
(SEQ ID NO: 3766; Homo sapiens AR, transcript
variant 1; GenBank Accession No. NM_000044.2):
CGAGATCCCGGGGAGCCAGCTTGCTGGGAGAGCGGGACGGTCCGGAGCA

AGCCCAGAGGCAGAGGAGGCGACAGAGGGAAAAAGGGCCGAGCTAGCC

GCTCCAGTGCTGTACAGGAGCCGAAGGGACGCACCACGCCAGCCCCAGCC

CGGCTCCAGCGACAGCCAACGCCTCTTGCAGCGCGGCGGCTTCGAAGCCG

CCGCCCGGAGCTGCCCTTTCCTCTTCGGTGAAGTTTTTAAAAGCTGCTAA

AGACTCGGAGGAAGCAAGGAAAGTGCCTGGTAGGACTGACGGCTGCCTTT

GTCCTCCTCCTCTCCACCCCGCCTCCCCCACCCTGCTTCCCCCCCTC

CCCCGTCTTCTCTCCCGCAGCTGCCTCAGTCGGCTACTCTCAGCCAAC

CCCCCTCACCACCCTTCTCCCCACCCGCCCCCCCGCCCCCGTCGGCCCA

GCGCTGCCAGCCCGAGTTTGCAGAGAGGTAACTCCCTTTGGCTGCGAGC

GGGCGAGCTAGCTGCACATTGCAAAGAAGGCTCTTAGGAGCCAGGCGAC

TGGGGAGCGGCTTCAGCACTGCAGCCACGACCCGCCTGGTTAGGCTGCA

CGCGGAGAGAACCCTCTGTTTTCCCCCACTCTCTCTCCACCTCCTCCTG

CCTTCCCCACCCCGAGTGCGGAGCCAGAGATCAAAAGATGAAAAGGCAG

TCAGGTCTTCAGTAGCCAAAAAACAAAACAAACAAAAACAAAAAAGCCG

AAATAAAAGAAAAAGATAATAACTCAGTTCTTATTTGCACCTACTTCAG

TGGACACTGAATTTGGAAGGTGGAGGATTTTGTTTTTTTCTTTTAAGAT

CTGGGCATCTTTTGAATCTACCCTTCAAGTATTAAGAGACAGACTGTGA

GCCTAGCAGGGCAGATCTTGTCCACCGTGTGTCTTCTTCTGCACGAGAC

TTTGAGGCTGTCAGAGCGCTTTTTGCGTGGTTGCTCCCGCAAGTTTCCT

TCTCTGGAGCTTCCCGCAGGTGGGCAGCTAGCTGCAGCGACTACCGCAT

CATCACAGCCTGTTGAACTCTTCTGAGCAAGAGAAGGGGAGGCGGGGTA

AGGGAAGTAGGTGGAAGATTCAGCCAAGCTCAAGGATGGAAGTGCAGTT

AGGGCTGGGAAGGGTCTACCCTCGGCCGCCGTCCAAGACCTACCGAGGA

GCTTTCCAGAATCTGTTCCAGAGCGTGCGCGAAGTGATCCAGAACCCGG

GCCCCAGGCACCCAGAGGCCGCGAGCGCAGCACCTCCCGGCGCCAGTTT

GCTGCTGCTGCAGCAGCAGCAGCAGCAGCAGCAGCAGCAGCAGCAGCAG

CAGCAGCAGCAGCAGCAGCAGCAGCAGCAAGAGACTAGCCCCAGGCAGC

AGCAGCAGCAGCAGGGTGAGGATGGTTCTCCCCAAGCCCATCGTAGAGG

CCCCACAGGCTACCTGGTCCTGGATGAGGAACAGCAACCTTCACAGCCG

CAGTCGGCCCTGGAGTGCCACCCCGAGAGAGGTTGCGTCCCAGAGCCTG

GAGCCGCCGTGGCCGCCAGCAAGGGGCTGCCGCAGCAGCTGCCAGCACC

TCCGGACGAGGATGACTCAGCTGCCCCATCCACGTTGTCCCTGCTGGGC

CCCACTTTCCCCGGCTTAAGCAGCTGCTCCGCTGACCTTAAAGACATCC

TGAGCGAGGCCAGCACCATGCAACTCCTTCAGCAACAGCAGCAGGAAGC

AGTATCCGAAGGCAGCAGCAGCGGGAGAGCGAGGGAGGCCTCGGGGGCT

CCCACTTCCTCCAAGGACAATTACTTAGGGGGCACTTCGACCATTTCTG

ACAACGCCAAGGAGTTGTGTAAGGCAGTGTCGGTGTCCATGGGCCTGGG

TGTGGAGGCGTTGGAGCATCTGAGTCCAGGGGAACAGCTTCGGGGGGAT

TGCATGTACGCCCCACTTTTGGGAGTTCCACCCGCTGTGCGTCCCACTC

CTTGTGCCCCATTGGCCGAATGCAAAGGTTCTCTGCTAGACGACAGCGC

AGGCAAGAGCACTGAAGATACTGCTGAGTATTCCCCTTTCAAGGGAGGT

TACACCAAAGGGCTAGAAGGCGAGAGCCTAGGCTGCTCTGGCAGCGCTG

CAGCAGGGAGCTCCGGGACACTTGAACTGCCGTCTACCCTGTCTCTCTA

CAAGTCCGGAGCACTGGACGAGGCAGCTGCGTACCAGAGTCGCGACTAC

TACAACTTTCCACTGGCTCTGGCCGGACCGCCGCCCCCTCCGCCGCCTC

CCCATCCCCACGCTCGCATCAAGCTGGAGAACCCGCTGGACTACGGCAG

CGCCTGGGCGGCTGCGGCGGCGCAGTGCCGCTATGGGGACCTGGCGAGC

CTGCATGGCGCGGGTGCAGCGGGACCCGGTTCTGGGTCACCCTCAGCCGC

CGCTTCCTCATCCTGGCACACTCTCTTCACAGCCGAAGAAGGCCAGTTGT
```

```
ATGGACCGTGTGGTGGTGGTGGGGGTGGTGGCGGCGGCGGCGGCGGC
GGCGGCGGCGGCGGCGGCGGCGGCGGCGAGGCGGGAGCTGTAGCCC
CCTACGGCTACACTCGGCCCCCTCAGGGGCTGGCGGGCCAGGAAAGCGAC
TTCACCGCACCTGATGTGTGGTACCCTGGCGGCATGGTGAGCAGAGTGCC
CTATCCCAGTCCCACTTGTGTCAAAAGCGAAATGGGCCCCTGGATGGATA
GCTACTCCGGACCTTACGGGACATGCGTTTGGAGACTGCCAGGGACCAT
GTTTTGCCCATTGACTATTACTTTCCACCCCAGAAGACCTGCCTGATCTG
TGGAGATGAAGCTTCTGGGTGTCACTATGGAGCTCTCACATGTGGAAGCT
GCAAGGTCTTCTTCAAAAGAGCCGCTGAAGGGAAACAGAAGTACCTGTGC
GCCAGCAGAAATGATTGCACTATTGATAAATTCCGAAGGAAAAATTGTCC
ATCTTGTCGTCTTCGGAAATGTTATGAAGCAGGGATGACTCTGGGAGCCC
GGAAGCTGAAGAAACTTGGTAATCTGAAACTACAGGAGGAAGGAGAGGCT
TCCAGCACCACCAGCCCCACTGAGGAGACAACCCAGAAGCTGACAGTGTC
ACACATTGAAGGCTATGAATGTCAGCCCATCTTTCTGAATGTCCTGGAAG
CCATTGAGCCAGGTGTAGTGTGTGCTGGACACGACAACAACCAGCCCGAC
TCCTTTGCAGCCTTGCTCTCTAGCCTCAATGAACTGGGAGAGAGACAGCT
TGTACACGTGGTCAAGTGGGCCAAGGCCTTGCCTGGCTTCCGCAACTTAC
ACGTGGACGACCAGATGGCTGTCATTCAGTACTCCTGGATGGGGCTCATG
GTGTTTGCCATGGGCTGGCGATCCTTCACCAATGTCAACTCCAGGATGCT
CTACTTCGCCCCTGATCTGGTTTTCAATGAGTACCGCATGCACAAGTCC
CGGATGTACAGCCAGTGTGTCCGAATGAGGCACCTCTCTCAAGAGTTTG
GATGGCTCCAAATCACCCCCCAGGAATTCCTGTGCATGAAAGCACTGCT
ACTCTTCAGCATTATTCCAGTGGATGGGCTGAAAAATCAAAAATTCTTT
GATGAACTTCGAATGAACTACATCAAGGAACTCGATCGTATCATTGCAT
GCAAAAGAAAAAATCCCACATCCTGCTCAAGACGCTTCTACCAGCTCAC
CAAGCTCCTGGACTCCGTCAGCCTATTGCGAGAGAGCTGCATCAGTTCA
CTTTTGACCTGCTAATCAAGTCACACATGGTGAGCGTGGACTTTCCGGA
AATGATGGCAGAGATCATCTCTGTGCAAGTGCCCAAGATCCTTTCTGGG
AAAGTCAAGCCCATCTATTTCCACACCCAGTGAAGCATTGGAAACCCTA
TTTCCCCACCCCAGCTCATGCCCCCTTTCAGATGTCTTCTGCCTGTTAT
AACTCTGCACTACTCCTCTGCAGTGCCTTGGGGAATTTCCTCTATTGAT
GTACAGTCTGTCATGAACATGTTCCTGAATTCTATTTGCTGGGCTTTTT
TTTTCTCTTTCTCTCCTTTCTTTTTCTTCTTCCCTCCCTATCTAACCCT
CCCATGGCACCTTCAGACTTTGCTTCCCATTGTGGCTCCTATCTGTGTT
TTGAATGGTGTTGTATGCCTTTAAATCTGTGATGATCCTCATATGGCCC
AGTGTCAAGTTGTGCTTGTTTACAGCACTACTCTGTGCCAGCCACACAA
ACGTTTACTTATCTTATGCCACGGGAAGTTTAGAGAGCTAAGATTATCT
GGGGAAATCAAAACAAAAACAAGCAAAC
```

Human Wild-type AR sequence, long transcript, amino acid Sequence NP_000035.2
(SEQ ID NO: 3767; translation of NM_000044.2):
MEVQLGLGRVYPRPPSKTYRGAFQNLFQSVREVIQNPGPRHPEAASAAP PGASLLLLQQQQQQQQQQQQQQQQQQQQQQQQETSPRQQQQQQGEDGSPQ
AHRRGPTGYLVLDEEQQPSQPQSALECHPERGCVPEPGAAVAASKGLPQ
QLPAPPDEDDSAAPSTLSLLGPTFPGLSSCSADLKDILSEASTMQLLQQ
QQQEAVSEGSSSGRAREASGAPTSSKDNYLGGTSTISDNAKELCKAVSV
SMGLGVEALEHLSPGEQLRGDCMYAPLLGVPPAVRPTPCAPLAECKGSL
LDDSAGKSTEDTAEYSPFKGGYTKGLEGESLGCSGSAAAGSSGTLELPS
TLSLYKSGALDEAAAYQSRDYYNFPLALAGPPPPPPPPHPHARIKLENP
LDYGSAWAAAAAQCRYGDLASLHGAGAAGPGSGSPSAAASSSWHTLFTA
EEGQLYGPCGGGGGGGGGGGGGGGGGGGGEAGAVAPYGYTRPPQGL
AGQESDFTAPDVWYPGGMVSRVPYPSPTCVKSEMGPWMDSYSGPYGDMR
LETARDHVLPIDYYFPPQKTCLICGDEASGCHYGALTCGSCKVFFKRAA
EGKQKYLCASRNDCTIDKFRRKNCPSCRLRKCYEAGMTLGARKLKKLGN
LKLQEEGEASSTTSPTEETTQKLTVSHIEGYECQPIFLNVLEAIEPGVV
CAGHDNNQPDSFAALLSSLNELGERQLVHVVKWAKALPGFRNLHVDDQM
AVIQYSWMGLMVFAMGWRSFTNVNSRMLYFAPDLVFNEYRMHKSRMYSQ
CVRMRHLSQEFGWLQITPQEFLCMKALLLFSIIPVDGLKNQKFFDELRM
NYIKELDRIIACKRKNPTSCSRRFYQLTKLLLDSVQPIARELHQFTFDLL
IKSHMVSVDFPEMMAEIISVQVPKILSGKVKPIYFHTQ Human Wild-type AR sequence, short transcript (SEQ ID NO: 3768; *Homo sapiens* AR, transcript variant 2; GenBank Accession No. NM_001011645.1):
```
GCTGCGAGCAGAGAGGGATTCCTCGGAGGTCATCTGTTCCATCTTCTTG
CCTATGCAAATGCCTGCCTGAAGCTGCTGGAGGCTGGCTTTGTACCGGA
CTTTGTACAGGGAACCAGGGAAACGAATGCAGAGTGCTCCTGACATTGC
CTGTCACTTTTTCCCATGATACTCTGGCTTCACAGTTTGGAGACTGCCA
GGGACCATGTTTTGCCCATTGACTATTACTTTCCACCCCAGAAGACCTG
CCTGATCTGTGGAGATGAAGCTTCTGGGTGTCACTATGGAGCTCTCACA
TGTGGAAGCTGCAAGGTCTTCTTCAAAAGAGCCGCTGAAGGGAAACAGA
AGTACCTGTGCGCCAGCAGAAATGATTGCACTATTGATAAATTCCGAAG
GAAAAATTGTCCATCTTGTCGTCTTCGGAAATGTTATGAAGCAGGGATG
ACTCTGGGAGCCCGGAAGCTGAAGAAACTTGGTAATCTGAAACTACAGG
AGGAAGGAGAGGCTTCCAGCACCACCAGCCCCACTGAGGAGACAACCCA
GAAGCTGACAGTGTCACACATTGAAGGCTATGAATGTCAGCCCATCTTT
CTGAATGTCCTGGAAGCCATTGAGCCAGGTGTAGTGTGTGCTGGACACG
ACAACAACCAGCCCGACTCCTTTGCAGCCTTGCTCTCTAGCCTCAATGA
ACTGGGAGAGAGACAGCTTGTACACGTGGTCAAGTGGGCCAAGGCCTTG
CCTGGCTTCCGCAACTTACACGTGGACGACCAGATGGCTGTCATTCAGT
ACTCCTGGATGGGGCTCATGGTGTTTGCCATGGGCTGGCGATCCTTCAC
CAATGTCAACTCCAGGATGCTCTACTTCGCCCCTGATCTGGTTTTCAAT
GAGTACCGCATGCACAAGTCCCGGATGTACAGCCAGTGTGTCCGAATGA
GGCACCTCTCTCAAGAGTTTGGATGGCTCCAAATCACCCCCCAGGAATT
CCTGTGCATGAAAGCACTGCTACTCTTCAGCATTATTCCAGTGGATGGG
```

CTGAAAAATCAAAAATTCTTTGATGAACTTCGAATGAACTACATCAAGG

AACTCGATCGTATCATTGCATGCAAAAGAAAAAATCCCACATCCTGCTC

AAGACGCTTCTACCAGCTCACCAAGCTCCTGGACTCCGTGCAGCCTATT

GCGAGAGAGCTGCATCAGTTCACTTTTGACCTGCTAATCAAGTCACACA

TGGTGAGCGTGGACTTTCCGGAAATGATGGCAGAGATCATCTCTGTGCA

AGTGCCCAAGATCCTTTCTGGGAAAGTCAAGCCCATCTATTTCCACACC

CAGTGAAGCATTGGAAACCCTATTTCCCCACCCCAGCTCATGCCCCCTT

TCAGATGTCTTCTGCCTGTTATAACTCTGCACTACTCCTCTGCAGTGCC

TTGGGGAATTTCCTCTATTGATGTACAGTCTGTCATGAACATGTTCCTG

AATTCTATTTGCTGGGCTTTTTTTTCTCTTTCTCTCCTTTCTTTTTCT

TCTTCCCTCCCTATCTAACCCTCCCATGGCACCTTCAGACTTTGCTTCC

CATTGTGGCTCCTATCTGTGTTTTGAATGGTGTTGTATGCCTTTAAATC

TGTGATGATCCTCATATGGCCCAGTGTCAAGTTGTGCTTGTTTACAGCA

CTACTCTGTGCCAGCCACACAAACGTTTACTTATCTTATGCCACGGGAA

GTTTAGAGAGCTAAGATTATCTGGGGAAATCAAAACAAAAACAAGCAAAC

Human Wild-type AR sequence, short transcript,
amino acid Sequence NP_001011645.1 (SEQ ID NO:
3769; translation of NM_001011645.1):
MILWLHSLETARDHVLPIDYYFPPQKTCLICGDEASGCHYGALTCGSCK

VFFKRAAEGKQKYLCASRNDCTIDKFRRKNCPSCRLRKCYEAGMTLGAR

KLKKLGNLKLQEEGEASSTTSPTEETTQKLTVSHIEGYECQPIFLNVLE

AIEPGVVCAGHDNNQPDSFAALLSSLNELGERQLVHVVKWAKALPGFRN

LHVDDQMAVIQYSWMGLMVFAMGWRSFTNVNSRMLYFAPDLVFNEYRMH

KSRMYSQCVRMRHLSQEFGWLQITPQEFLCMKALLLFSIIPVDGLKNQK

FFDELRMNYIKELDRIIACKRKNPTSCSRRFYQLTKLLDSVQPIARELH

QFTFDLLIKSHMVSVDFPEMMAEIISVQVPKILSGKVKPIYFHTQ

Mouse Wild-type AR sequence (SEQ ID NO: 3770;
Mus musculus C57BL/6 AR transcript; GenBank
Accession No. NM_013476.3):
GAATTCGGTGGAAGCTACAGACAAGCTCAAGGATGGAGGTGCAGTTAGG

GCTGGGAAGGGTCTACCCACGGCCCCCATCCAAGACCTATCGAGGAGCGT

TCCAGAATCTGTTCCAGAGCGTGCGCGAAGCGATCCAGAACCCGGGCCCC

AGGCACCCTGAGGCCGCTAACATAGCACCTCCCGGCGCCTGTTTACAGCA

GAGGCAGGAGACTAGCCCCCGGCGGCGGCGGCGGCAGCAGCACACTGAG

GATGGTTCTCCTCAAGCCCACATCAGAGGCCCCACAGGCTACCTGGCCCT

GGAGGAGGAACAGCAGCCTTCACAGCAGCAGGCAGCCTCCGAGGGCCAC

CCTGAGAGCAGCTGCCTCCCCGAGCCTGGGGCGGCCACCGCTCCTGGCAA

GGGGCTGCCGCAGCAGCCACCAGCTCCTCCAGATCAGGATGACTCAGCTG

CCCCATCCACGTTGTCCCTGCTGGGCCCCACTTTCCCAGGCTTAAGCAGC

TGCTCCGCCGACATTAAAGACATTTTGAACGAGGCCGGCACCATGCAACT

TCTTCAGCAGCAGCAACAACAGCAGCAGCACCAACAGCAGCACCAACAGC

ACCAACAGCAGCAGGAGGTAATCTCCGAAGGCAGCAGCGCAAGAGCCAG

GGAGGCCACGGGGGCTCCCTCTTCCTCCAAGGATAGTTACCTAGGGGGCA

ATTCAACCATATCTGACAGTGCCAAGGAGTTGTGTAAAGCAGTGTCTGTG

TCCATGGGATTGGGTGTGGAAGCATTGGAACATCTGAGTCCAGGGGAACA

GCTTCGGGGAGACTGCATGTACGCGTCGCTCCTGGGAGGTCCACCCGCGG

TGCGTCCCACTCCTTGTGCGCCGCTGCCCGAATGCAAAGGTCTTCCCCTG

GACGAAGGCCCAGGCAAAAGCACTGAAGAGACTGCTGAGTATTCCTCTTT

CAAGGGAGGTTACGCCAAAGGATTGGAAGGTGAGAGCTTGGGGTGCTCTG

GCAGCAGTGAAGCAGGTAGCTCTGGGACACTTGAGATCCCGTCCTCTCTG

TCTCTGTATAAATCTGGAGCACTAGACGAGGCAGCAGCATACCAGAATCG

CGACTACTACAACTTTCCGCTGGCTCTGTCCGGGCCGCCGCACCCCCCGC

CCCCTACCCATCCACACGCCCGTATCAAGCTGGAGAACCCATTGGACTAC

GGCAGCGCCTGGGCTGCGGCGGCAGCGCAATGCCGCTATGGGGACTTGGG

TAGTCTACATGGAGGGAGTGTAGCCGGGCCCAGCACTGGATCGCCCCCAG

CCACCACCTCTTCTTCCTGGCATACTCTCTTCACAGCTGAAGAAGGCCAA

TTATATGGGCCAGGAGGCGGGGCGGCAGCAGCAGCCCAAGCGATGCCGG

GCCTGTAGCCCCCTATGGCTACACTCGGCCCCCTCAGGGGCTGACAAGCC

AGGAGAGTGACTACTCTGCCTCCGAAGTGTGGTATCCTGGTGGAGTTGTG

AACAGAGTACCCTATCCCAGTCCCAATTGTGTCAAAAGTGAAATGGGACC

TTGGATGGAGAACTACTCCGGACCTTATGGGGACATGCGTTTGGACAGTA

CCAGGGACCATGTTTTACCCATCGACTATTACTTTCCACCCCAGAAGACC

TGCCTGATCTGTGGAGATGAAGCTTCTGGCTGTCACTACGGAGCTCTCAC

TTGTGGCAGCTGCAAGGTCTTCTTCAAAAGAGCCGCTGAAGGGAAACAGA

AGTATCTATGTGCCAGCAGAAACGATTGTACCATTGATAAATTTCGGAGG

AAAAATTGCCCATCTTGTCGTCTCCGGAAATGTTATGAAGCAGGGATGAC

TCTGGGAGCTCGTAAGCTGAAGAAACTTGGAAATCTAAAACTACAGGAGG

AAGGAGAAAACTCCAATGCTGGCAGCCCCACTGAGGACCCATCCCAGAAG

ATGACTGTATCACACATTGAAGGCTATGAATGTCAGCCTATCTTTCTTAA

CGTCCTGGAAGCCATTGAGCCAGGAGTGGTGTGTGCCGGACATGACAACA

ACCAACCAGATTCCTTTGCTGCCTTGTTATCTAGCCTCAATGAGCTTGGA

GAGAGGCAGCTTGTGCATGTGGTCAAGTGGGCCAAGGCCTTGCCTGGCTT

CCGCAACTTGCATGTGGATGACCAGATGGCGGTCATTCAGTATTCCTGGA

TGGGACTGATGGTATTTGCCATGGGTTGGCGGTCCTTCACTAATGTCAAC

TCCAGGATGCTCTACTTTGCACCTGACTTGGTTTTCAATGAGTACCGCAT

GCACAAGTCTCGGATGTACAGCCAGTGTGTGAGGATGAGGCACCTGTCTC

AAGAGTTTGGATGGCTCCAAATAACCCCCCAGGAATTCCTGTGCATGAAA

GCACTGCTGCTCTTCAGCATTATTCCAGTGGATGGGCTGAAAAATCAAAA

ATTCTTTGATGAACTTCGAATGAACTACATCAAGGAACTCGATCGCATCA

TTGCATGCAAAAGAAAGAATCCCACATCCTGCTCAAGGCGCTTCTACCAG

CTCACCAAGCTCCTGGATTCTGTGCAGCCTATTGCAAGAGAGCTGCATCA

GTTCACTTTTGACCTGCTAATCAAGTCCCATATGGTGAGCGTGGACTTTC

TGAAATGATGGCAGAGATCATCTCTGTGCAAGTGCCCAAGATCCTTTCT

-continued

```
GGGAAAGTCAAGCCCATCTATTTCCACACACAGTGAAGATTTGGAAACCC

TAATACCCAAAACCCACCTTGTTCCCTTTCCAGATGTCTTCTGCCTGTTA

TATAACTCTGCACTACTTCTCTGCAGTGCCTTGGGGGAAATTCCTCTACT

GATGTACAGTCTGTCGTGAACAGGTTCCTCAGTTCTATTTCCTGGGCTTC

TCCTTCTTTTTTTTCTTCTTCCCTCCCTCTTTCACCCTCCCATGGCACA

TTTTGAATCTGCTGCGTATTGTGGCTCCTGCCTTTGTTTTGATTTCTGTT

GTA
```

Mouse Wild-type AR Amino Acid Sequence NP_038504.1
(SEQ ID NO: 3771; translation of NM_013476.3):

```
MEVQLGLGRVYPRPPSKTYRGAFQNLFQSVREAIQNPGPRHPEAANIAPP

GACLQQRQETSPRRRRQQHTEDGSPQAHIRGPTGYLALEEEQQPSQQQ

AASEGHPESSCLPEPGAATAPGKGLPQQPPAPPDQDDSAAPSTLSLLGP

TFPGLSSCSADIKDILNEAGTMQLLQQQQQQQQHQQQHQQHQQQQEVIS

EGSSARAREATGAPSSSKDSYLGGNSTISDSAKELCKAVSVSMGLGVEA

LEHLSPGEQLRGDCMYASLLGGPPAVRPTPCAPLPECKGLPLDEGPGKS

TEETAEYSSFKGGYAKGLEGESLGCSGSSEAGSSGTLEIPSSLSLYKSG

ALDEAAAYQNRDYYNFPLALSGPPHPPPPTHPHARIKLENPLDYGSAWA

AAAAQCRYGDLGSLHGGSVAGPSTGSPPATTSSSWHTLFTAEEGQLYGP

GGGGGSSSPSDAGPVAPYGYTRPPQGLTSQESDYSASEVWYPGGVVNRV

PYPSPNCVKSEMGPWMENYSGPYGDMRLDSTRDHVLPIDYYFPPQKTCL

ICGDEASGCHYGALTCGSCKVFFKRAAEGKQKYLCASRNDCTIDKFRRK

NCPSCRLRKCYEAGMTLGARKLKKLGNLKLQEEGENSNAGSPTEDPSQK

MTVSHIEGYECQPIFLNVLEAIEPGVVCAGHDNNQPDSFAALLSSLNEL

GERQLVHVVKWAKALPGFRNLHVDDQMAVIQYSWMGLMVFAMGWRSFTN

VNSRMLYFAPDLVFNEYRMHKSRMYSQCVRMRHLSQEFGWLQITPQEFL

CMKALLLFSIIPVDGLKNQKFFDELRMNYIKELDRIIACKRKNPTSCSR

RFYQLTKLLDSVQPIARELHQFTFDLLIKSHMVSVDFPEMMAEIISVQV

PKILSGKVKPIYFHTQ
```

In Vitro Assay to Assess DsiRNA AR Inhibitory Activity

An in vitro assay that recapitulates RNAi in a cell-free system can be used to evaluate DsiRNA constructs targeting AR RNA sequence(s), and thus to assess AR-specific gene inhibitory activity (also referred to herein as AR inhibitory activity) of a DsiRNA. The assay comprises the system described by Tuschl et al., 1999, *Genes and Development*, 13, 3191-3197 and Zamore et al., 2000, *Cell*, 101, 25-33 adapted for use with DsiRNA agents directed against AR RNA. A *Drosophila* extract derived from syncytial blastoderm is used to reconstitute RNAi activity in vitro. Target RNA is generated via in vitro transcription from a selected AR expressing plasmid using T7 RNA polymerase or via chemical synthesis. Sense and antisense DsiRNA strands (for example 20 uM each) are annealed by incubation in buffer (such as 100 mM potassium acetate, 30 mM HEPES-KOH, pH 7.4, 2 mM magnesium acetate) for 1 minute at 90° C. followed by 1 hour at 37° C., then diluted in lysis buffer (for example 100 mM potassium acetate, 30 mM HEPES-KOH at pH 7.4, 2 mM magnesium acetate). Annealing can be monitored by gel electrophoresis on an agarose gel in TBE buffer and stained with ethidium bromide. The *Drosophila* lysate is prepared using zero to two-hour-old embryos from Oregon R flies collected on yeasted molasses agar that are dechorionated and lysed. The lysate is centrifuged and the supernatant isolated. The assay comprises a reaction mixture containing 50% lysate [vol/vol], RNA (10-50 pM final concentration), and 10% [vol/vol] lysis buffer containing DsiRNA (10 nM final concentration). The reaction mixture also contains 10 mM creatine phosphate, 10 ug/ml creatine phosphokinase, 100 um GTP, 100 uM UTP, 100 uM CTP, 500 uM ATP, 5 mM DTT, 0.1 U/uL RNasin (Promega), and 100 uM of each amino acid. The final concentration of potassium acetate is adjusted to 100 mM. The reactions are pre-assembled on ice and preincubated at 25° C. for 10 minutes before adding RNA, then incubated at 25° C. for an additional 60 minutes. Reactions are quenched with 4 volumes of 1.25× Passive Lysis Buffer (Promega). Target RNA cleavage is assayed by RT-PCR analysis or other methods known in the art and are compared to control reactions in which DsiRNA is omitted from the reaction.

Alternately, internally-labeled target RNA for the assay is prepared by in vitro transcription in the presence of [alpha-$^{32}$P] CTP, passed over a G50 Sephadex column by spin chromatography and used as target RNA without further purification. Optionally, target RNA is 5'-$^{32}$P-end labeled using T4 polynucleotide kinase enzyme. Assays are performed as described above and target RNA and the specific RNA cleavage products generated by RNAi are visualized on an autoradiograph of a gel. The percentage of cleavage is determined by PHOSPHOR IMAGER® (autoradiography) quantitation of bands representing intact control RNA or RNA from control reactions without DsiRNA and the cleavage products generated by the assay.

In one embodiment, this assay is used to determine target sites in the AR RNA target for DsiRNA mediated RNAi cleavage, wherein a plurality of DsiRNA constructs are screened for RNAi mediated cleavage of the AR RNA target, for example, by analyzing the assay reaction by electrophoresis of labeled target RNA, or by northern blotting, as well as by other methodology well known in the art.

In certain embodiments, a DsiRNA of the invention is deemed to possess AR inhibitory activity if, e.g., a 50% reduction in AR RNA levels is observed in a system, cell, tissue or organism, relative to a suitable control. Additional metes and bounds for determination of AR inhibitory activity of a DsiRNA of the invention are described supra.

Conjugation and Delivery of Anti-AR DsiRNA Agents

In certain embodiments the present invention relates to a method for treating a subject having an AR-associated disease or disorder, or at risk of developing an AR-associated disease or disorder. In such embodiments, the DsiRNA can act as novel therapeutic agents for controlling the AR-associated disease or disorder. The method comprises administering a pharmaceutical composition of the invention to the patient (e.g., human), such that the expression, level and/or activity of an AR RNA is reduced. The expression, level and/or activity of a polypeptide encoded by an AR RNA might also be reduced by a DsiRNA of the instant invention, even where said DsiRNA is directed against a non-coding region of the AR transcript (e.g., a targeted 5' UTR or 3' UTR sequence). Because of their high specificity, the DsiRNAs of the present invention can specifically target AR sequences of cells and tissues, optionally in an allele-specific manner where polymorphic alleles exist within an individual and/or population.

In the treatment of an AR-associated disease or disorder, the DsiRNA can be brought into contact with the cells or tissue of a subject, e.g., the cells or tissue of a subject exhibiting disregulation of AR and/or otherwise targeted for reduction of AR levels. For example, DsiRNA substantially identical to all or part of an AR RNA sequence, may be brought into contact with or introduced into such a cell, either in vivo or in vitro. Similarly, DsiRNA substantially identical to all or part of an AR RNA sequence may administered directly to a subject having or at risk of developing an AR-associated disease or disorder.

Therapeutic use of the DsiRNA agents of the instant invention can involve use of formulations of DsiRNA agents comprising multiple different DsiRNA agent sequences. For example, two or more, three or more, four or more, five or more, etc. of the presently described agents can be combined to produce a formulation that, e.g., targets multiple different regions of the AR RNA, or that not only target AR RNA but also target, e.g., cellular target genes associated with an AR-associated disease or disorder. A DsiRNA agent of the instant invention may also be constructed such that either strand of the DsiRNA agent independently targets two or more regions of AR RNA, or such that one of the strands of the DsiRNA agent targets a cellular target gene of AR known in the art.

Use of multifunctional DsiRNA molecules that target more then one region of a target nucleic acid molecule can also provide potent inhibition of AR RNA levels and expression. For example, a single multifunctional DsiRNA construct of the invention can target both the AR-770 and AR-2947 sites simultaneously; additionally and/or alternatively, single or multifunctional agents of the invention can be designed to selectively target one splice variant of AR over another.

Thus, the DsiRNA agents of the instant invention, individually, or in combination or in conjunction with other drugs, can be used to treat, inhibit, reduce, or prevent an AR-associated disease or disorder. For example, the DsiRNA molecules can be administered to a subject or can be administered to other appropriate cells evident to those skilled in the art, individually or in combination with one or more drugs under conditions suitable for the treatment.

The DsiRNA molecules also can be used in combination with other known treatments to treat, inhibit, reduce, or prevent an AR-associated disease or disorder in a subject or organism. For example, the described molecules could be used in combination with one or more known compounds, treatments, or procedures to treat, inhibit, reduce, or prevent an AR-associated disease or disorder in a subject or organism as are known in the art.

A DsiRNA agent of the invention can be conjugated (e.g., at its 5' or 3' terminus of its sense or antisense strand) or unconjugated to another moiety (e.g. a non-nucleic acid moiety such as a peptide), an organic compound (e.g., a dye, cholesterol, or the like). Modifying DsiRNA agents in this way may improve cellular uptake or enhance cellular targeting activities of the resulting DsiRNA agent derivative as compared to the corresponding unconjugated DsiRNA agent, are useful for tracing the DsiRNA agent derivative in the cell, or improve the stability of the DsiRNA agent derivative compared to the corresponding unconjugated DsiRNA agent.

Methods of Introducing Nucleic Acids, Vectors, and Host Cells

DsiRNA agents of the invention may be directly introduced into a cell (i.e., intracellularly); or introduced extracellularly into a cavity, interstitial space, into the circulation of an organism, introduced orally, or may be introduced by bathing a cell or organism in a solution containing the nucleic acid. Vascular or extravascular circulation, the blood or lymph system, and the cerebrospinal fluid are sites where the nucleic acid may be introduced.

The DsiRNA agents of the invention can be introduced using nucleic acid delivery methods known in art including injection of a solution containing the nucleic acid, bombardment by particles covered by the nucleic acid, soaking the cell or organism in a solution of the nucleic acid, or electroporation of cell membranes in the presence of the nucleic acid. Other methods known in the art for introducing nucleic acids to cells may be used, such as lipid-mediated carrier transport, chemical-mediated transport, and cationic liposome transfection such as calcium phosphate, and the like. The nucleic acid may be introduced along with other components that perform one or more of the following activities: enhance nucleic acid uptake by the cell or other-wise increase inhibition of the target AR RNA.

A cell having a target AR RNA may be from the germ line or somatic, totipotent or pluripotent, dividing or non-dividing, parenchyma or epithelium, immortalized or transformed, or the like. The cell may be a stem cell or a differentiated cell. Cell types that are differentiated include adipocytes, fibroblasts, myocytes, cardiomyocytes, endothelium, neurons, glia, blood cells, megakaryocytes, lymphocytes, macrophages, neutrophils, eosinophils, basophils, mast cells, leukocytes, granulocytes, keratinocytes, chondrocytes, osteoblasts, osteoclasts, hepatocytes, and cells of the endocrine or exocrine glands.

Depending on the particular target AR RNA sequence and the dose of DsiRNA agent material delivered, this process may provide partial or complete loss of function for the AR RNA. A reduction or loss of RNA levels or expression (either AR RNA expression or encoded polypeptide expression) in at least 50%, 60%, 70%, 80%, 90%, 95% or 99% or more of targeted cells is exemplary Inhibition of AR RNA levels or expression refers to the absence (or observable decrease) in the level of AR RNA or AR RNA-encoded protein. Specificity refers to the ability to inhibit the AR RNA without manifest effects on other genes of the cell. The consequences of inhibition can be confirmed by examination of the outward properties of the cell or organism or by biochemical techniques such as RNA solution hybridization, nuclease protection, Northern hybridization, reverse transcription, gene expression monitoring with a microarray, antibody binding, enzyme linked immunosorbent assay (ELISA), Western blotting, radioimmunoassay (RIA), other immunoassays, and fluorescence activated cell analysis (FACS) Inhibition of target AR RNA sequence(s) by the DsiRNA agents of the invention also can be measured based upon the effect of administration of such DsiRNA agents upon development/progression of an AR-associated disease or disorder, e.g., tumor formation, growth, metastasis, etc., either in vivo or in vitro. Treatment and/or reductions in tumor or cancer cell levels can include halting or reduction of growth of tumor or cancer cell levels or reductions of, e.g., 10%, 20%, 30%, 40%, 50%, 60%, 70%, 80%, 90%, 95% or 99% or more, and can also be measured in logarithmic terms, e.g., 10-fold, 100-fold, 1000-fold, $10^5$-fold, $10^6$-fold, $10^7$-fold reduction in cancer cell levels could be achieved via administration of the DsiRNA agents of the invention to cells, a tissue, or a subject.

For RNA-mediated inhibition in a cell line or whole organism, expression a reporter or drug resistance gene whose protein product is easily assayed can be measured. Such reporter genes include acetohydroxyacid synthase (AHAS), alkaline phosphatase (AP), beta galactosidase (LacZ), beta glucoronidase (GUS), chloramphenicol acetyltransferase (CAT), green fluorescent protein (GFP), horseradish peroxidase (HRP), luciferase (Luc), nopaline synthase (NOS), octopine synthase (OCS), and derivatives thereof. Multiple selectable markers are available that confer resistance to ampicillin, bleomycin, chloramphenicol, gentarnycin, hygromycin, kanamycin, lincomycin, methotrexate, phosphinothricin, puromycin, and tetracyclin. Depending on the assay, quantitation of the amount of gene expression allows one to determine a degree of inhibition which is greater than 10%, 33%, 50%, 90%, 95% or 99% as compared to a cell not treated according to the present invention.

Lower doses of injected material and longer times after administration of RNA silencing agent may result in inhibition in a smaller fraction of cells (e.g., at least 10%, 20%, 50%, 75%, 90%, or 95% of targeted cells). Quantitation of gene expression in a cell may show similar amounts of inhibition at the level of accumulation of target AR RNA or translation of target protein. As an example, the efficiency of inhibition may be determined by assessing the amount of gene product in the cell; RNA may be detected with a hybridization probe having a nucleotide sequence outside the region used for the inhibitory DsiRNA, or translated polypeptide may be detected with an antibody raised against the polypeptide sequence of that region.

The DsiRNA agent may be introduced in an amount which allows delivery of at least one copy per cell. Higher doses (e.g., at least 5, 10, 100, 500 or 1000 copies per cell) of material may yield more effective inhibition; lower doses may also be useful for specific applications.

Pharmaceutical Compositions

In certain embodiments, the present invention provides for a pharmaceutical composition comprising the DsiRNA agent of the present invention. The DsiRNA agent sample can be suitably formulated and introduced into the environment of the cell by any means that allows for a sufficient portion of the sample to enter the cell to induce gene silencing, if it is to occur. Many formulations for dsRNA are known in the art and can be used so long as the dsRNA gains entry to the target cells so that it can act. See, e.g., U.S. published patent application Nos. 2004/0203145 A1 and 2005/0054598 A1. For example, the DsiRNA agent of the instant invention can be formulated in buffer solutions such as phosphate buffered saline solutions, liposomes, micellar structures, and capsids. Formulations of DsiRNA agent with cationic lipids can be used to facilitate transfection of the DsiRNA agent into cells. For example, cationic lipids, such as lipofectin (U.S. Pat. No. 5,705,188), cationic glycerol derivatives, and polycationic molecules, such as polylysine (published PCT International Application WO 97/30731), can be used. Suitable lipids include Oligofectamine, Lipofectamine (Life Technologies), NC388 (Ribozyme Pharmaceuticals, Inc., Boulder, Colo.), or FuGene 6 (Roche) all of which can be used according to the manufacturer's instructions.

Such compositions typically include the nucleic acid molecule and a pharmaceutically acceptable carrier. As used herein the language "pharmaceutically acceptable carrier" includes saline, solvents, dispersion media, coatings, antibacterial and antifungal agents, isotonic and absorption delaying agents, and the like, compatible with pharmaceutical administration. Supplementary active compounds can also be incorporated into the compositions.

A pharmaceutical composition is formulated to be compatible with its intended route of administration. Examples of routes of administration include parenteral, e.g., intravenous, intradermal, subcutaneous, oral (e.g., inhalation), transdermal (topical), transmucosal, and rectal administration. Solutions or suspensions used for parenteral, intradermal, or subcutaneous application can include the following components: a sterile diluent such as water for injection, saline solution, fixed oils, polyethylene glycols, glycerine, propylene glycol or other synthetic solvents; antibacterial agents such as benzyl alcohol or methyl parabens; antioxidants such as ascorbic acid or sodium bisulfite; c22Rv1ting agents such as ethylenediaminetetraacetic acid; buffers such as acetates, citrates or phosphates and agents for the adjustment of tonicity such as sodium chloride or dextrose. pH can be adjusted with acids or bases, such as hydrochloric acid or sodium hydroxide. The parenteral preparation can be enclosed in ampoules, disposable syringes or multiple dose vials made of glass or plastic.

Pharmaceutical compositions suitable for injectable use include sterile aqueous solutions (where water soluble) or dispersions and sterile powders for the extemporaneous preparation of sterile injectable solutions or dispersion. For intravenous administration, suitable carriers include physiological saline, bacteriostatic water, Cremophor EL™ (BASF, Parsippany, N.J.) or phosphate buffered saline (PBS). In all cases, the composition must be sterile and should be fluid to the extent that easy syringability exists. It should be stable under the conditions of manufacture and storage and must be preserved against the contaminating action of microorganisms such as bacteria and fungi. The carrier can be a solvent or dispersion medium containing, for example, water, ethanol, polyol (for example, glycerol, propylene glycol, and liquid polyetheylene glycol, and the like), and suitable mixtures thereof. The proper fluidity can be maintained, for example, by the use of a coating such as lecithin, by the maintenance of the required particle size in the case of dispersion and by the use of surfactants. Prevention of the action of microorganisms can be achieved by various antibacterial and antifungal agents, for example, parabens, chlorobutanol, phenol, ascorbic acid, thimerosal, and the like. In many cases, it will be preferable to include isotonic agents, for example, sugars, polyalcohols such as manitol, sorbitol, sodium chloride in the composition. Prolonged absorption of the injectable compositions can be brought about by including in the composition an agent which delays absorption, for example, aluminum monostearate and gelatin.

Sterile injectable solutions can be prepared by incorporating the active compound in the required amount in a selected solvent with one or a combination of ingredients enumerated above, as required, followed by filtered sterilization. Generally, dispersions are prepared by incorporating the active compound into a sterile vehicle, which contains a basic dispersion medium and the required other ingredients from those enumerated above. In the case of sterile powders for the preparation of sterile injectable solutions, the preferred methods of preparation are vacuum drying and freeze-drying which yields a powder of the active ingredient plus any additional desired ingredient from a previously sterile-filtered solution thereof.

Oral compositions generally include an inert diluent or an edible carrier. For the purpose of oral therapeutic administration, the active compound can be incorporated with excipients and used in the form of tablets, troches, or capsules, e.g., gelatin capsules. Oral compositions can also be prepared using a fluid carrier for use as a mouthwash. Pharmaceutically compatible binding agents, and/or adjuvant materials can be included as part of the composition. The tablets, pills, capsules, troches and the like can contain any of the following ingredients, or compounds of a similar nature: a binder such as microcrystalline cellulose, gum tragacanth or gelatin; an excipient such as starch or lactose, a disintegrating agent such as alginic acid, Primogel, or corn starch; a lubricant such as magnesium stearate or Sterotes; a glidant such as colloidal silicon dioxide; a sweetening agent such as sucrose or saccharin; or a flavoring agent such as peppermint, methyl salicylate, or orange flavoring.

For administration by inhalation, the compounds are delivered in the form of an aerosol spray from pressured container or dispenser which contains a suitable propellant, e.g., a gas such as carbon dioxide, or a nebulizer. Such methods include those described in U.S. Pat. No. 6,468,798.

Systemic administration can also be by transmucosal or transdermal means. For transmucosal or transdermal administration, penetrants appropriate to the barrier to be permeated are used in the formulation. Such penetrants are generally known in the art, and include, for example, for transmucosal administration, detergents, bile salts, and fusidic acid derivatives. Transmucosal administration can be accomplished through the use of nasal sprays or suppositories. For transdermal administration, the active compounds are formulated into ointments, salves, gels, or creams as generally known in the art.

The compounds can also be prepared in the form of suppositories (e.g., with conventional suppository bases such as cocoa butter and other glycerides) or retention enemas for rectal delivery.

The compounds can also be administered by transfection or infection using methods known in the art, including but not limited to the methods described in McCaffrey et al. (2002), Nature, 418(6893), 38-9 (hydrodynamic transfection); Xia et al. (2002), Nature Biotechnol., 20(10), 1006-10 (viral-mediated delivery); or Putnam (1996), Am. J. Health Syst. Pharm. 53(2), 151-160, erratum at Am. J. Health Syst. Pharm. 53(3), 325 (1996).

The compounds can also be administered by a method suitable for administration of nucleic acid agents, such as a DNA vaccine. These methods include gene guns, bio injectors, and skin patches as well as needle-free methods such as the micro-particle DNA vaccine technology disclosed in U.S. Pat. No. 6,194,389, and the mammalian transdermal needle-free vaccination with powder-form vaccine as disclosed in U.S. Pat. No. 6,168,587. Additionally, intranasal delivery is possible, as described in, inter alia, Hamajima et al. (1998), Clin. Immunol. Immunopathol., 88(2), 205-10. Liposomes (e.g., as described in U.S. Pat. No. 6,472,375) and microencapsulation can also be used. Biodegradable targetable microparticle delivery systems can also be used (e.g., as described in U.S. Pat. No. 6,471,996).

In one embodiment, the active compounds are prepared with carriers that will protect the compound against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, and polylactic acid. Such formulations can be prepared using standard techniques. The materials can also be obtained commercially from Alza Corporation and Nova Pharmaceuticals, Inc. Liposomal suspensions (including liposomes targeted to infected cells with monoclonal antibodies to viral antigens) can also be used as pharmaceutically acceptable carriers. These can be prepared according to methods known to those skilled in the art, for example, as described in U.S. Pat. No. 4,522,811.

Toxicity and therapeutic efficacy of such compounds can be determined by standard pharmaceutical procedures in cell cultures or experimental animals, e.g., for determining the $LD_{50}$ (the dose lethal to 50% of the population) and the $ED_{50}$ (the dose therapeutically effective in 50% of the population). The dose ratio between toxic and therapeutic effects is the therapeutic index and it can be expressed as the ratio $LD_{50}/ED_{50}$. Compounds which exhibit high therapeutic indices are preferred. While compounds that exhibit toxic side effects may be used, care should be taken to design a delivery system that targets such compounds to the site of affected tissue in order to minimize potential damage to uninfected cells and, thereby, reduce side effects.

The data obtained from the cell culture assays and animal studies can be used in formulating a range of dosage for use in humans. The dosage of such compounds lies preferably within a range of circulating concentrations that include the $ED_{50}$ with little or no toxicity. The dosage may vary within this range depending upon the dosage form employed and the route of administration utilized. For a compound used in the method of the invention, the therapeutically effective dose can be estimated initially from cell culture assays. A dose may be formulated in animal models to achieve a circulating plasma concentration range that includes the $IC_{50}$ (i.e., the concentration of the test compound which achieves a half-maximal inhibition of symptoms) as determined in cell culture. Such information can be used to more accurately determine useful doses in humans. Levels in plasma may be measured, for example, by high performance liquid chromatography.

As defined herein, a therapeutically effective amount of a nucleic acid molecule (i.e., an effective dosage) depends on the nucleic acid selected. For instance, if a plasmid encoding a DsiRNA agent is selected, single dose amounts in the range of approximately 1 pg to 1000 mg may be administered; in some embodiments, 10, 30, 100, or 1000 pg, or 10, 30, 100, or 1000 ng, or 10, 30, 100, or 1000 µg, or 10, 30, 100, or 1000 mg may be administered. In some embodiments, 1-5 g of the compositions can be administered. The compositions can be administered one from one or more times per day to one or more times per week; including once every other day. The skilled artisan will appreciate that certain factors may influence the dosage and timing required to effectively treat a subject, including but not limited to the severity of the disease or disorder, previous treatments, the general health and/or age of the subject, and other diseases present. Moreover, treatment of a subject with a therapeutically effective amount of a protein, polypeptide, or antibody can include a single treatment or, preferably, can include a series of treatments.

The nucleic acid molecules of the invention can be inserted into expression constructs, e.g., viral vectors, retroviral vectors, expression cassettes, or plasmid viral vectors, e.g., using methods known in the art, including but not limited to those described in Xia et al., (2002), supra. Expression constructs can be delivered to a subject by, for example, inhalation, orally, intravenous injection, local administration (see U.S. Pat. No. 5,328,470) or by stereotactic injection (see e.g., Chen et al. (1994), Proc. Natl. Acad. Sci. USA, 91, 3054-3057). The pharmaceutical preparation of the delivery vector can include the vector in an acceptable diluent, or can comprise a slow release matrix in which the delivery vehicle is imbedded. Alternatively, where the complete delivery vector can be produced intact from recombinant cells, e.g., retroviral vectors, the pharmaceutical preparation can include one or more cells which produce the gene delivery system.

The expression constructs may be constructs suitable for use in the appropriate expression system and include, but are not limited to retroviral vectors, linear expression cassettes, plasmids and viral or virally-derived vectors, as known in the art. Such expression constructs may include one or more inducible promoters, RNA Pol III promoter systems such as U6 snRNA promoters or H1 RNA polymerase III promoters, or other promoters known in the art. The constructs can include one or both strands of the siRNA. Expression constructs expressing both strands can also include loop structures linking both strands, or each strand can be separately transcribed from separate promoters within the same construct. Each strand can also be transcribed from a separate expression construct, e.g., Tuschl (2002, *Nature Biotechnol* 20: 500-505).

It can be appreciated that the method of introducing DsiRNA agents into the environment of the cell will depend on the type of cell and the make up of its environment. For example, when the cells are found within a liquid, one preferable formulation is with a lipid formulation such as in lipofectamine and the DsiRNA agents can be added directly to the liquid environment of the cells. Lipid formulations can also be administered to animals such as by intravenous, intramuscular, or intraperitoneal injection, or orally or by inhalation or other methods as are known in the art. When the formulation is suitable for administration into animals such as mammals and more specifically humans, the formulation is also pharmaceutically acceptable. Pharmaceutically acceptable formulations for administering oligonucleotides are known and can be used. In some instances, it may be preferable to formulate DsiRNA agents in a buffer or saline solution and directly inject the formulated DsiRNA agents into cells, as in studies with oocytes. The direct injection of DsiRNA agents duplexes may also be done. For suitable methods of introducing dsRNA (e.g., DsiRNA agents), see U.S. published patent application No. 2004/0203145 A1.

Suitable amounts of a DsiRNA agent must be introduced and these amounts can be empirically determined using standard methods. Typically, effective concentrations of individual DsiRNA agent species in the environment of a cell will be 50 nanomolar or less, 10 nanomolar or less, or compositions in which concentrations of 1 nanomolar or less can be used. In another embodiment, methods utilizing a concentration of 200 picomolar or less, 100 picomolar or less, 50 picomolar or less, 20 picomolar or less, and even a concentration of 10 picomolar or less, 5 picomolar or less, 2 picomolar or less or 1 picomolar or less can be used in many circumstances.

The method can be carried out by addition of the DsiRNA agent compositions to an extracellular matrix in which cells can live provided that the DsiRNA agent composition is formulated so that a sufficient amount of the DsiRNA agent can enter the cell to exert its effect. For example, the method is amenable for use with cells present in a liquid such as a liquid culture or cell growth media, in tissue explants, or in whole organisms, including animals, such as mammals and especially humans.

The level or activity of an AR RNA can be determined by a suitable method now known in the art or that is later developed. It can be appreciated that the method used to measure a target RNA and/or the expression of a target RNA can depend upon the nature of the target RNA. For example, where the target AR RNA sequence encodes a protein, the term "expression" can refer to a protein or the AR RNA/transcript derived from the AR gene (either genomic or of exogenous origin). In such instances the expression of the target AR RNA can be determined by measuring the amount of AR RNA/transcript directly or by measuring the amount of AR protein. Protein can be measured in protein assays such as by staining or immunoblotting or, if the protein catalyzes a reaction that can be measured, by measuring reaction rates. All such methods are known in the art and can be used. Where target AR RNA levels are to be measured, art-recognized methods for detecting RNA levels can be used (e.g., RT-PCR, Northern Blotting, etc.). In targeting AR RNAs with the DsiRNA agents of the instant invention, it is also anticipated that measurement of the efficacy of a DsiRNA agent in reducing levels of AR RNA or protein in a subject, tissue, in cells, either in vitro or in vivo, or in cell extracts can also be used to determine the extent of reduction of AR-associated phenotypes (e.g., disease or disorders, e.g., cancer or tumor formation, growth, metastasis, spread, etc.). The above measurements can be made on cells, cell extracts, tissues, tissue extracts or other suitable source material.

The determination of whether the expression of an AR RNA has been reduced can be by a suitable method that can reliably detect changes in RNA levels. Typically, the determination is made by introducing into the environment of a cell undigested DsiRNA such that at least a portion of that DsiRNA agent enters the cytoplasm, and then measuring the level of the target RNA. The same measurement is made on identical untreated cells and the results obtained from each measurement are compared.

The DsiRNA agent can be formulated as a pharmaceutical composition which comprises a pharmacologically effective amount of a DsiRNA agent and pharmaceutically acceptable carrier. A pharmacologically or therapeutically effective amount refers to that amount of a DsiRNA agent effective to produce the intended pharmacological, therapeutic or preventive result. The phrases "pharmacologically effective amount" and "therapeutically effective amount" or simply "effective amount" refer to that amount of an RNA effective to produce the intended pharmacological, therapeutic or preventive result. For example, if a given clinical treatment is considered effective when there is at least a 20% reduction in a measurable parameter associated with a disease or disorder, a therapeutically effective amount of a drug for the treatment of that disease or disorder is the amount necessary to effect at least a 20% reduction in that parameter.

Suitably formulated pharmaceutical compositions of this invention can be administered by means known in the art such as by parenteral routes, including intravenous, intramuscular, intraperitoneal, subcutaneous, transdermal, airway (aerosol), rectal, vaginal and topical (including buccal and sublingual) administration. In some embodiments, the pharmaceutical compositions are administered by intravenous or intraparenteral infusion or injection.

In general, a suitable dosage unit of dsRNA will be in the range of 0.001 to 0.25 milligrams per kilogram body weight of the recipient per day, or in the range of 0.01 to 20 micrograms per kilogram body weight per day, or in the range of 0.01 to 10 micrograms per kilogram body weight per day, or in the range of 0.10 to 5 micrograms per kilogram body weight per day, or in the range of 0.1 to 2.5 micrograms per kilogram body weight per day. Pharmaceutical composition comprising the dsRNA can be administered once daily. However, the therapeutic agent may also be dosed in dosage units containing two, three, four, five, six or more sub-doses administered at appropriate intervals throughout the day. In that case, the dsRNA contained in each sub-dose must be correspondingly smaller in order to achieve the total daily dosage unit. The dosage unit can also be compounded for a single dose over several days, e.g., using a conventional sustained release formulation which provides sustained and consistent release of the dsRNA over a several day period. Sustained release formulations are well known in the art. In this embodiment, the dosage unit contains a corresponding multiple of the daily dose. Regardless of the formulation, the pharmaceutical composition must contain dsRNA in a quantity sufficient to inhibit expression of the target gene in the animal or human being treated. The composition can be compounded in such a way that the sum of the multiple units of dsRNA together contain a sufficient dose.

Data can be obtained from cell culture assays and animal studies to formulate a suitable dosage range for humans. The dosage of compositions of the invention lies within a range of circulating concentrations that include the $ED_{50}$ (as determined by known methods) with little or no toxicity. The dosage may vary within this range depending upon the dosage form employed and the route of administration utilized. For a compound used in the method of the invention, the therapeutically effective dose can be estimated initially from cell culture assays. A dose may be formulated in animal models to achieve a circulating plasma concentration range of the compound that includes the $IC_{50}$ (i.e., the concentration of the test compound which achieves a half-maximal inhibition of symptoms) as determined in cell culture. Such information can be used to more accurately determine useful doses in humans. Levels of dsRNA in plasma may be measured by standard methods, for example, by high performance liquid chromatography.

The pharmaceutical compositions can be included in a kit, container, pack, or dispenser together with instructions for administration.

Methods of Treatment

The present invention provides for both prophylactic and therapeutic methods of treating a subject at risk of (or susceptible to) a disease or disorder caused, in whole or in part, by AR (e.g., misregulation and/or elevation of AR transcript and/or AR protein levels), or treatable via selective targeting of AR.

"Treatment", or "treating" as used herein, is defined as the application or administration of a therapeutic agent (e.g., a DsiRNA agent or vector or transgene encoding same) to a patient, or application or administration of a therapeutic agent to an isolated tissue or cell line from a patient, who has the disease or disorder, a symptom of disease or disorder or a predisposition toward a disease or disorder, with the purpose to cure, heal, alleviate, relieve, alter, remedy, ameliorate, improve or affect the disease or disorder, the symptoms of the disease or disorder, or the predisposition toward disease.

In one aspect, the invention provides a method for preventing in a subject, a disease or disorder as described above (including, e.g., prevention of the commencement of transforming events within a subject via inhibition of AR expression), by administering to the subject a therapeutic agent (e.g., a DsiRNA agent or vector or transgene encoding same). Subjects at risk for the disease can be identified by, for example, one or a combination of diagnostic or prognostic assays as described herein. Administration of a prophylactic agent can occur prior to the detection of, e.g., cancer in a subject, or the manifestation of symptoms characteristic of the disease or disorder, such that the disease or disorder is prevented or, alternatively, delayed in its progression.

Another aspect of the invention pertains to methods of treating subjects therapeutically, i.e., altering the onset of symptoms of the disease or disorder. These methods can be performed in vitro (e.g., by culturing the cell with the DsiRNA agent) or, alternatively, in vivo (e.g., by administering the DsiRNA agent to a subject).

With regards to both prophylactic and therapeutic methods of treatment, such treatments may be specifically tailored or modified, based on knowledge obtained from the field of pharmacogenomics. "Pharmacogenomics", as used herein, refers to the application of genomics technologies such as gene sequencing, statistical genetics, and gene expression analysis to drugs in clinical development and on the market. More specifically, the term refers the study of how a patient's genes determine his or her response to a drug (e.g., a patient's "drug response phenotype", or "drug response genotype"). Thus, another aspect of the invention provides methods for tailoring an individual's prophylactic or therapeutic treatment with either the target AR RNA molecules of the present invention or target AR RNA modulators according to that individual's drug response genotype. Pharmacogenomics allows a clinician or physician to target prophylactic or therapeutic treatments to patients who will most benefit from the treatment and to avoid treatment of patients who will experience toxic drug-related side effects.

Therapeutic agents can be tested in a selected animal model. For example, a DsiRNA agent (or expression vector or transgene encoding same) as described herein can be used in an animal model to determine the efficacy, toxicity, or side effects of treatment with said agent. Alternatively, an agent (e.g., a therapeutic agent) can be used in an animal model to determine the mechanism of action of such an agent.

Models Useful to Evaluate the Down-Regulation of AR mRNA Levels and Expression

Cell Culture

The DsiRNA agents of the invention can be tested for cleavage activity in vivo, for example, using the following procedure. The nucleotide sequences within the AR cDNA targeted by the DsiRNA agents of the invention are shown in the above AR sequences.

The DsiRNA reagents of the invention can be tested in cell culture using 22Rv1 or other mammalian cells to determine the extent of AR RNA and AR protein inhibition. DsiRNA reagents (e.g., see FIG. 1, and above-recited structures) are selected against the AR target as described herein. AR RNA inhibition is measured after delivery of these reagents by a suitable transfection agent to, for example, cultured 22Rv1 cells or other transformed or non-transformed mammalian cells in culture. Relative amounts of target AR RNA are measured versus actin or other appropriate control using real-time PCR monitoring of amplification (e.g., ABI 7700 TAQ-MAN®). A comparison is made to a mixture of oligonucleotide sequences made to unrelated targets or to a randomized DsiRNA control with the same overall length and chemistry, but randomly substituted at each position, or simply to appropriate vehicle-treated or untreated controls. Primary and secondary lead reagents are chosen for the target and optimization performed. After a transfection agent concentration is chosen, a RNA time-course of inhibition is performed with the lead DsiRNA molecule.

TAQMAN® (Real-Time PCR Monitoring of Amplification) and Lightcycler Quantification of mRNA Total RNA is prepared from cells following DsiRNA delivery, for example, using Ambion Rnaqueous 4-PCR purification kit for large scale extractions, or Promega SV96 for 96-well assays. For Taqman analysis, dual-labeled probes are synthesized with, for example, the reporter dyes FAM or VIC covalently linked at the 5'-end and the quencher dye TAMARA conjugated to the 3'-end. PCR amplifications are performed on, for example, an ABI PRISM 7700 Sequence detector using 50 uL reactions consisting of 10 uL total RNA, 100 nM forward primer, 100 mM reverse primer, 100 nM probe, 1×TaqMan PCR reaction buffer (PE-Applied Biosystems), 5.5 mM MgCl2, 100 uM each dATP, dCTP, dGTP and dTTP, 0.2U RNase Inhibitor (Promega), 0.025U AmpliTaq Gold (PE-Applied Biosystems) and 0.2U M-MLV Reverse Transcriptase (Promega). The thermal cycling conditions can consist of 30 minutes at 48° C., 10 minutes at 95° C., followed by 40 cycles of 15 seconds at 95° C. and 1 minute at 60° C. Quantitation of target AR mRNA level is determined relative to standards generated from serially diluted total cellular RNA (300, 100, 30, 10 ng/rxn) and normalizing to, for example, 36B4 mRNA in either parallel or same tube TaqMan reactions.

Western Blotting

Cellular protein extracts can be prepared using a standard micro preparation technique (for example using RIPA buffer). Cellular protein extracts are run on 4-12% Tris-Glycine polyacrylamide gel and transferred onto membranes. Non-specific binding can be blocked by incubation, for example, with 5% non-fat milk for 1 hour followed by primary antibody for 16 hours at 4° C. Following washes, the secondary antibody is applied, for example (1:10,000 dilution) for 1 hour at room temperature and the signal detected on a VersaDoc imaging system In several cell culture systems, cationic lipids have been shown to enhance the bioavailability of oligonucleotides to cells in culture (Bennet, et al., 1992, Mol. Pharmacology, 41, 1023-1033). In one embodiment, DsiRNA molecules of the invention are complexed with cationic lipids for cell culture experiments. DsiRNA and cationic lipid mixtures are prepared in serum-free OptimMEM (InVitrogen) immediately prior to addition to the cells. OptiMEM is warmed to room temperature (about 20-25° C.) and cationic lipid is added to the final desired concentration. DsiRNA molecules are added to OptiMEM to the desired concentration and the solution is added to the diluted DsiRNA and incubated for 15 minutes at room temperature. In dose response experiments, the RNA complex is serially diluted into OptiMEM prior to addition of the cationic lipid.

Animal Models

The efficacy of anti-AR DsiRNA agents may be evaluated in an animal model. Animal models of cancer and/or proliferative diseases, conditions, or disorders as are known in the art can be used for evaluation of the efficacy, potency, toxicity, etc. of anti-AR DsiRNAs. Suitable animal models of proliferative disease include, e.g., transgenic rodents (e.g., mice, rats) bearing gain of function proto-oncogenes (e.g., Myc, Src) and/or loss of function of tumour suppressor proteins (e.g., p53, Rb) or rodents that have been exposed to radiation or chemical mutagens that induce DNA changes that facilitate neoplastic transformation. Many such animal models are commercially available, for example, from The Jackson Laboratory, Bar Harbor, Me., USA. These animal models may be used as a source cells or tissue for assays of the compositions of the invention. Such models can also be used or adapted for use for pre-clinical evaluation of the efficacy of DsiRNA compositions of the invention in modulating AR gene expression toward therapeutic use.

As in cell culture models, the most AR relevant mouse tumor xenografts are those derived from cancer cells that express AR proteins. Xenograft mouse models of prostate cancer relevant to study of the anti-tumor effect of modulating AR have been described by various groups (Compagno et al. *PLoS One*, 2: e1006, study of injected anti-AR siRNA into mice bearing exponentially growing castration-resistant tumors; Dehm et al. *Cancer Res*. 68: 5469-77, identification of a constitutively active AR that mediates prostate cancer therapy resistance in the 22Rv1 PCa cell line; Azuma et al. *Biochem Biophys Res Commun*. 391: 1075-9, study of siRNA targeting AR in LNCaP and 22Rv1 human prostate cancer cells). Use of these models has demonstrated that inhibition of AR expression by anti-AR agents causes inhibition of tumor growth in animals.

Such models can be used in evaluating the efficacy of DsiRNA molecules of the invention to inhibit AR levels, expression, tumor/cancer formation, growth, spread, development of other AR-associated phenotypes, diseases or disorders, etc. These models and others can similarly be used to evaluate the safety/toxicity and efficacy of DsiRNA molecules of the invention in a pre-clinical setting.

Specific examples of animal model systems useful for evaluation of the AR-targeting DsiRNAs of the invention include wild-type mice, and orthotopic or subcutaneous LNCaP or 22Rv1 xenograft tumor model mice. In an exemplary in vivo experiment, DsiRNAs of the invention are tail vein injected into such mouse models at doses ranging from 1 to 10 mg/kg or, alternatively, repeated doses are administered at single-dose $IC_{50}$ levels, and organs (e.g., prostate, liver, kidney, lung, pancreas, colon, skin, spleen, bone marrow, lymph nodes, mammary fat pad, etc.) are harvested 24 hours after administration of the final dose. Such organs are then evaluated for mouse and/or human AR levels, depending upon the model used. Duration of action can also be examined at, e.g., 1, 4, 7, 14, 21 or more days after final DsiRNA administration.

The practice of the present invention employs, unless otherwise indicated, conventional techniques of chemistry, molecular biology, microbiology, recombinant DNA, genetics, immunology, cell biology, cell culture and transgenic biology, which are within the skill of the art. See, e.g., Maniatis et al., 1982, Molecular Cloning (Cold Spring Harbor Laboratory Press, Cold Spring Harbor, N.Y.); Sambrook et al., 1989, Molecular Cloning, 2nd Ed. (Cold Spring Harbor Laboratory Press, Cold Spring Harbor, N.Y.); Sambrook and Russell, 2001, Molecular Cloning, 3rd Ed. (Cold Spring Harbor Laboratory Press, Cold Spring Harbor, N.Y.); Ausubel et al., 1992), Current Protocols in Molecular Biology (John Wiley & Sons, including periodic updates); Glover, 1985, DNA Cloning (IRL Press, Oxford); Anand, 1992; Guthrie and Fink, 1991; Harlow and Lane, 1988, Antibodies, (Cold Spring Harbor Laboratory Press, Cold Spring Harbor, N.Y.); Jakoby and Pastan, 1979; Nucleic Acid Hybridization (B. D. Hames & S. J. Higgins eds. 1984); Transcription And Translation (B. D. Hames & S. J. Higgins eds. 1984); Culture Of Animal Cells (R. I. Freshney, Alan R. Liss, Inc., 1987); Immobilized Cells And Enzymes (IRL Press, 1986); B. Perbal, A Practical Guide To Molecular Cloning (1984); the treatise, Methods In Enzymology (Academic Press, Inc., N.Y.); Gene Transfer Vectors For Mammalian Cells (J. H. Miller and M. P. Calos eds., 1987, Cold Spring Harbor Laboratory); Methods In Enzymology, Vols. 154 and 155 (Wu et al. eds), Immunochemical Methods In Cell And Molecular Biology (Mayer and Walker, eds., Academic Press, London, 1987); Handbook Of Experimental Immunology, Volumes I-IV (D. M. Weir and C. C. Blackwell, eds., 1986); Riott, Essential Immunology, 6th Edition, Blackwell Scientific Publications, Oxford, 1988; Hogan et al., Manipulating the Mouse Embryo, (Cold Spring Harbor Laboratory Press, Cold Spring Harbor, N.Y., 1986); Westerfield, M., The zebrafish book. A guide for the laboratory use of zebrafish (*Danio rerio*), (4th Ed., Univ. of Oregon Press, Eugene, 2000).

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

EXAMPLES

The present invention is described by reference to the following Examples, which are offered by way of illustration and are not intended to limit the invention in any manner.

Standard techniques well known in the art or the techniques specifically described below were utilized.

Example 1

Anti-AR DsiRNA Design

Preferred anti-AR DsiRNA agents were selected from a pre-screened population of DsiRNAs. Design of DsiRNAs can optionally involve use of predictive scoring algorithms that perform in silico assessments of the projected activity/efficacy of a number of possible DsiRNAs spanning a region of sequence.

Example 2

Preparation And Assay of Double-Stranded RNA Oligonucleotides

Oligonucleotide Synthesis and Purification

DsiRNA molecules can be designed to interact with various sites in the RNA message, for example, target sequences within the RNA sequences described herein. In presently exemplified agents, two target AR sequences were selected. The sequence of one strand of the DsiRNA molecules were complementary to the target AR site sequences described above. The DsiRNA molecules were chemically synthesized using methods described herein. Generally, DsiRNA constructs were synthesized using solid phase oligonucleotide synthesis methods as described for 19-23mer siRNAs (see for example Usman et al., U.S. Pat. Nos. 5,804,683; 5,831,071; 5,998,203; 6,117,657; 6,353,098; 6,362,323; 6,437,117; 6,469,158; Scaringe et al., U.S. Pat. Nos. 6,111,086; 6,008,400; 6,111,086).

Individual RNA strands were synthesized and HPLC purified according to standard methods (Integrated DNA Technologies, Coralville, Iowa). For example, RNA oligonucleotides were synthesized using solid phase phosphoramidite chemistry, deprotected and desalted on NAP-5 columns (Amersham Pharmacia Biotech, Piscataway, N.J.) using standard techniques (Damha and Olgivie, 1993, *Methods Mol Biol* 20: 81-114; Wincott et al., 1995, *Nucleic Acids Res* 23: 2677-84). The oligomers were purified using ion-exchange high performance liquid chromatography (IE-HPLC) on an Amersham Source 15Q column (1.0 cm×25 cm; Amersham Pharmacia Biotech, Piscataway, N.J.) using a 15 mM step-linear gradient. The gradient varies from 90:10 Buffers A:B to 52:48 Buffers A:B, where Buffer A is 100 mM Tris pH 8.5 and Buffer B is 100 mM Tris pH 8.5, 1 M NaCl. Samples were monitored at 260 nm and peaks corresponding to the full-length oligonucleotide species are collected, pooled, desalted on NAP-5 columns, and lyophilized.

The purity of each oligomer was determined by capillary electrophoresis (CE) on a Beckman PACE 5000 (Beckman Coulter, Inc., Fullerton, Calif.). The CE capillaries had a 100 μm inner diameter and contains ssDNA 100R Gel (Beckman-Coulter). Typically, about 0.6 nmole of oligonucleotide was injected into a capillary, run in an electric field of 444 V/cm and detected by UV absorbance at 260 nm Denaturing Tris-Borate-7 M-urea running buffer was purchased from Beckman-Coulter. Oligoribonucleotides were obtained that are at least 90% pure as assessed by CE for use in experiments described below. Compound identity was verified by matrix-assisted laser desorption ionization time-of-flight (MALDI-TOF) mass spectroscopy on a Voyager DE™ Biospectometry Work Station (Applied Biosystems, Foster City, Calif.) following the manufacturer's recommended protocol. Relative molecular masses of all oligomers were obtained, often within 0.2% of expected molecular mass.

Preparation of Duplexes

Single-stranded RNA (ssRNA) oligomers were resuspended, e.g., at 100 pM concentration in duplex buffer consisting of 100 mM potassium acetate, 30 mM HEPES, pH 7.5. Complementary sense and antisense strands were mixed in equal molar amounts to yield a final solution of, e.g., 50 μM duplex. Samples were heated to 100° C. for 5' in RNA buffer (IDT) and allowed to cool to room temperature before use. Double-stranded RNA (dsRNA) oligomers were stored at −20° C. Single-stranded RNA oligomers were stored lyophilized or in nuclease-free water at −80° C.

Nomenclature

For consistency, the following nomenclature has been employed in the instant specification. Names given to duplexes indicate the length of the oligomers and the presence or absence of overhangs. A "25/27" is an asymmetric duplex having a 25 base sense strand and a 27 base antisense strand with a 2-base 3'-overhang. A "27/25" is an asymmetric duplex having a 27 base sense strand and a 25 base antisense strand.

Cell Culture and RNA Transfection

22Rv1 cells were obtained from ATCC and maintained in RPMI (HyClone) supplemented with 10% fetal bovine serum (HyClone) at 37° C. under 5% $CO_2$. LMTK-cells were obtained from ATCC and maintained in DMEM (HyClone) supplemented with 10% fetal bovine serum (HyClone) at 37° C. under 5% $CO_2$. For RNA transfections, cells were transfected with DsiRNAs as indicated at a final concentration of 1 nM or 0.1 nM using Lipofectamine™ RNAiMAX (Invitrogen) and following manufacturer's instructions. Briefly, an aliquot of stock solution of each DsiRNA was mixed with Opti-MEM I (Invitrogen) to reach a volume of 87.5 uL; Lipofectamine™ RNAiMAX was diluted in OptiMEM to 87.5 uL. The resulting 150 μL mix was added at 50 uL per well into triplicate individual wells of 96 well plates and incubated for 20 min at RT to allow DsiRNA:Lipofectamine™ RNAiMAX complexes to form. Meanwhile, 22Rv1 cells were trypsinized and resuspended in medium. Finally, 100 uL of the cell suspension were added to each well (final volume 150 uL) and plates were placed into the incubator for 24 hours.

Assessment of AR Inhibition

AR target gene knockdown was determined by qRT-PCR, with values normalized to HPRT and SFRS9 housekeeping genes, and to transfections with control DsiRNAs.

RNA Isolation and Analysis

Media was aspirated, and total RNA was extracted using the SV96 kit (Promega). Approximately 100 ng of total RNA was reverse-transcribed using SuperscriptII, Oligo dT, and random hexamers following manufacturer's instructions. Typically, on-sixth of the resulting cDNA was analyzed by qPCR using primers and probes specific for both the AR gene and for the human genes HPRT-1 and SFRS9. An ABI 7700 was used for the amplification reactions. Each sample was tested in triplicate. Relative AR RNA levels were normalized to HPRT1 and SFRS9 RNA levels and compared with RNA levels obtained in control samples treated with the control DsiRNAs.

Assessment of Protein and mRNA Knockdown in 22Rv1 Cells

22Rv1 cells were seeded in 6 well plates at a density of 400,000 cells/well in RPMI Media containing 10% FBS (No PS) and were transfected with control or AR DsiRNAs using Lipofectamine RNAiMAX (Invitrogen). After 24 and 48 hrs, cells were washed in PBS and lysed either in Triton protein lysis buffer for western blotting or in RNA lysis buffer for RNA extraction.

Quantitation of AR Proteins by Western Blot

For westerns, cells were washed with PBS and lysed with 0.3 ml lysis buffer containing 0.05 ml of 6× sample reducing buffer. 15 ul of this mixture was then loaded to 4-20% Tris Glycine gels and subjected to western immunoblotting. Primary antibodies to AR(N20) were obtained from Santa Cruz Biotechnology (Santa Cruz, Calif.) and antibody to alpha-tubulin was obtained from Sigma (St Louis Mo.). Fluorescent leveled secondary antibodies Alexa Fluor 488 were purchased from Invitrogen. A molecular weight ladder of protein markers from Invitrogen was run on each gel. The AR and α-tubulin bands were tentatively identified according to their migration on the blot. Quantitation of the protein band intensities was performed using the VersaDoc Imaging system 4000 MP and Quantity One 1-D Analysis Software (BIO-RAD) as per vendor's recommendations. The housekeeping protein, α-tubulin was used as an internal control for quantitation.

Quantitation of AR mRNA Via Multiplex qPCR

Total RNA was extracted according to the SV 96 Total RNA Isolation System (Promega) instructions and cDNA was made using a Transcriptor First Strand cDNA Synthesis Kit (Roche; using the Random Primer and a Heating Step of 5' @70° C.). qPCR was performed using BIO-RAD iQ Multiplex Powermix and the corresponding primer probe sets from Applied Biosystems (TaqMan® Gene Expression Assays). GAPDH or RPL23 housekeeping genes were used as internal controls.

Example 3

DsiRNA Inhibition of AR—Primary Screen

DsiRNA molecules targeting AR were designed and synthesized as described above and tested in 22Rv1 cells for inhibitory efficacy. For transfection, annealed DsiRNAs were mixed with the transfection reagent (Lipofectamine™ RNAiMAX, Invitrogen) in a volume of 50 μl/well and incubated for 20 minutes at room temperature. The 22Rv1 (human) or LMTK-(mouse) cells were trypsinized, resuspended in media, and added to wells (100 uL per well) to give a final DsiRNA concentration of 1 nM in a volume of 150 μl. Each DsiRNA transfection mixture was added to 3 wells for triplicate DsiRNA treatments. Cells were incubated at 37° C. for 24 hours in the continued presence of the DsiRNA transfection mixture. At 24 hours, RNA was prepared from each well of treated cells. The supernatants with the transfection mixtures were first removed and discarded, then the cells were lysed and RNA prepared from each well. Target AR RNA levels following treatment were evaluated by qRT-PCR for the AR target gene, with values normalized to those obtained for controls. Triplicate data was averaged and the % error determined for each treatment. Normalized data were graphed and the reduction of target mRNA by active DsiRNAs in comparison to controls was determined.

AR targeting DsiRNAs examined for AR inhibitory efficacy in a primary phase of testing included the following:

TABLE 9

| AR Tested Duplexes, Human | | | |
|---|---|---|---|
| | 5'-GCCAGCUUGCUGGGAGAGCGGGAcg-3'<br>3'-CUCGGUCGAACGACCCUCUCGCCCUGC-5' | (SEQ ID NO: 1501)<br>(SEQ ID NO: 1906) | |
| AR-39 Target: | 5'-GAGCCAGCTTGCTGGGAGAGCGGGACG-3' | (SEQ ID NO: 2311) | |
| | 5'-GCUCCAGCGACAGCCAACGCCUCtt-3'<br>3'-GCCGAGGUCGCUGUCGGUUGCGGAGAA-5' | (SEQ ID NO: 1502)<br>(SEQ ID NO: 1907) | |
| AR-174 Target: | 5'-CGGCTCCAGCGACAGCCAACGCCTCTT-3' | (SEQ ID NO: 2312) | |
| | 5'-GCCAACGCCUCUUGCAGCGCGGCgg-3'<br>3'-GUCGGUUGCGGAGAACGUCGCGCCGCC-5' | (SEQ ID NO: 1503)<br>(SEQ ID NO: 1908) | |
| AR-186 Target: | 5'-CAGCCAACGCCTCTTGCAGCGCGGCGG-3' | (SEQ ID NO: 2313) | |
| | 5'-CUCUUGCAGCGCGGCGGCUUCGAag-3'<br>3'-CGGAGAACGUCGCGCCGCCGAAGCUUC-5' | (SEQ ID NO: 1504)<br>(SEQ ID NO: 1909) | |
| AR-194 Target: | 5'-GCCTCTTGCAGCGCGGCGGCTTCGAAG-3' | (SEQ ID NO: 2314) | |
| | 5'-CAGCGCGGCGGCUUCGAAGCCGCcg-3'<br>3'-ACGUCGCGCCGCCGAAGCUUCGGCGGC-5' | (SEQ ID NO: 1505)<br>(SEQ ID NO: 1910) | |
| AR-200 Target: | 5'-TGCAGCGCGGCGGCTTCGAAGCCGCCG-3' | (SEQ ID NO: 2315) | |
| | 5'-AAGCCGCCGCCCGGAGCUGCCCUtt-3'<br>3'-GCUUCGGCGGCGGGCCUCGACGGGAAA-5' | (SEQ ID NO: 1506)<br>(SEQ ID NO: 1911) | |
| AR-216 Target: | 5'-CGAAGCCGCCGCCCGGAGCTGCCCTTT-3' | (SEQ ID NO: 2316) | |
| | 5'-CCGCCCGGAGCUGCCCUUUCCUCtt-3'<br>3'-GCGGCGGGCCUCGACGGGAAAGGAGAA-5' | (SEQ ID NO: 1507)<br>(SEQ ID NO: 1912) | |
| AR-222 Target: | 5'-CGCCGCCCGGAGCTGCCCTTTCCTCTT-3' | (SEQ ID NO: 2317) | |
| | 5'-AAGUUUUUAAAAGCUGCUAAAGAct-3'<br>3'-ACUUCAAAAAUUUUCGACGAUUUCUGA-5' | (SEQ ID NO: 1508)<br>(SEQ ID NO: 1913) | |

TABLE 9-continued

AR Tested Duplexes, Human

| | | | |
|---|---|---|---|
| AR-252 Target: | 5'-TGAAGTTTTTAAAAGCTGCTAAAGACT-3' | (SEQ ID NO: 2318) | |
| | 5'-GUCUUCUCUCCCGCAGCUGCCUCag-3' | (SEQ ID NO: 1509) | |
| | 3'-GGCAGAAGAGAGGGCGUCGACGGAGUC-5' | (SEQ ID NO: 1914) | |
| AR-375 Target: | 5'-CCGTCTTCTCTCCCGCAGCTGCCTCAG-3' | (SEQ ID NO: 2319) | |
| | 5'-GCAGCUGCCUCAGUCGGCUACUCtc-3' | (SEQ ID NO: 1510) | |
| | 3'-GGCGUCGACGGAGUCAGCCGAUGAGAG-5' | (SEQ ID NO: 1915) | |
| AR-387 Target: | 5'-CCGCAGCTGCCTCAGTCGGCTACTCTC-3' | (SEQ ID NO: 2320) | |
| | 5'-UGGCUGCGAGCGGGCGAGCUAGCtg-3' | (SEQ ID NO: 1511) | |
| | 3'-AAACCGACGCUCGCCCGCUCGAUCGAC-5' | (SEQ ID NO: 1916) | |
| AR-506 Target: | 5'-TTTGGCTGCGAGCGGGCGAGCTAGCTG-3' | (SEQ ID NO: 2321) | |
| | 5'-GGCGAGCUAGCUGCACAUUGCAAag-3' | (SEQ ID NO: 1512) | |
| | 3'-GCCCGCUCGAUCGACGUGUAACGUUUC-5' | (SEQ ID NO: 1917) | |
| AR-518 Target: | 5'-CGGGCGAGCTAGCTGCACATTGCAAAG-3' | (SEQ ID NO: 2322) | |
| | 5'-UCUCUCCACCUCCUCCUGCCUUCcc-3' | (SEQ ID NO: 1513) | |
| | 3'-AGAGAGAGGUGGAGGAGGACGGAAGGG-5' | (SEQ ID NO: 1918) | |
| AR-646 Target: | 5'-TCTCTCTCCACCTCCTCCTGCCTTCCC-3' | (SEQ ID NO: 2323) | |
| | 5'-AGAGAUCAAAAGAUGAAAAGGCAgt-3' | (SEQ ID NO: 1514) | |
| | 3'-GGUCUCUAGUUUUCUACUUUUCCGUCA-5' | (SEQ ID NO: 1919) | |
| AR-689 Target: | 5'-CCAGAGATCAAAGATGAAAAGGCAGT-3' | (SEQ ID NO: 2324) | |
| | 5'-GUAGCCAAAAAACAAAACAAACAaa-3' | (SEQ ID NO: 1515) | |
| | 3'-GUCAUCGGUUUUUUGUUUUGUUUGUUU-5' | (SEQ ID NO: 1920) | |
| AR-724 Target: | 5'-CAGTAGCCAAAAAACAAAACAAACAAA-3' | (SEQ ID NO: 2325) | |
| | 5'-AAAAAACAAAACAAACAAAAACAaa-3' | (SEQ ID NO: 1516) | |
| | 3'-GGUUUUUUGUUUUGUUUGUUUUUGUUU-5' | (SEQ ID NO: 1921) | |
| AR-730 Target: | 5'-CCAAAAAACAAAACAAACAAAAACAAA-3' | (SEQ ID NO: 2326) | |
| | 5'-AAAACAAACAAAAACAAAAAAGCcg-3' | (SEQ ID NO: 1517) | |
| | 3'-UGUUUUGUUUGUUUUGUUUUUUCGGC-5' | (SEQ ID NO: 1922) | |
| AR-737 Target: | 5'-ACAAAACAAACAAAAACAAAAAAGCCG-3' | (SEQ ID NO: 2327) | |
| | 5'-AAAAAAGCCGAAAUAAAAGAAAAag-3' | (SEQ ID NO: 1518) | |
| | 3'-UGUUUUUUCGGCUUUAUUUUCUUUUUC-5' | (SEQ ID NO: 1923) | |
| AR-752 Target: | 5'-ACAAAAAAGCCGAAATAAAAGAAAAG-3' | (SEQ ID NO: 2328) | |
| | 5'-CGAAAUAAAAGAAAAGAUAAUAac-3' | (SEQ ID NO: 1519) | |
| | 3'-CGGCUUUAUUUUCUUUUUCUAUUAUUG-5' | (SEQ ID NO: 1924) | |
| AR-760 Target: | 5'-GCCGAAATAAAAGAAAAAGATAATAAC-3' | (SEQ ID NO: 2329) | |
| | 5'-GAAAAAGAUAAUAACUCAGUUCUta-3' | (SEQ ID NO: 1520) | |
| | 3'-UUCUUUUUCUAUUAUUGAGUCAAGAAU-5' | (SEQ ID NO: 1925) | |
| AR-770 Target: | 5'-AAGAAAAAGATAATAACTCAGTTCTTA-3' | (SEQ ID NO: 2330) | |
| | 5'-AGAUAAUAACUCAGUUCUUAUUUgc-3' | (SEQ ID NO: 1521) | |
| | 3'-UUUCUAUUAUUGAGUCAAGAAUAAACG-5' | (SEQ ID NO: 1926) | |
| AR-775 Target: | 5'-AAAGATAATAACTCAGTTCTTATTTGC-3' | (SEQ ID NO: 2331) | |
| | 5'-UAAUAACUCAGUUCUUAUUUGCAcc-3' | (SEQ ID NO: 1522) | |
| | 3'-CUAUUAUUGAGUCAAGAAUAAACGUGG-5' | (SEQ ID NO: 1927) | |
| AR-778 Target: | 5'-GATAATAACTCAGTTCTTATTTGCACC-3' | (SEQ ID NO: 2332) | |
| | 5'-GAGGAUUUGUUUUUUUCUUUUAag-3' | (SEQ ID NO: 1523) | |
| | 3'-ACCUCCUAAAACAAAAAAAGAAAAUUC-5' | (SEQ ID NO: 1928) | |

TABLE 9-continued

AR Tested Duplexes, Human

| | | | |
|---|---|---|---|
| AR-833 Target: | 5'-TGGAGGATTTTGTTTTTTTCTTTTAAG-3' | (SEQ ID NO: 2333) | |
| | 5'-UUUUGUUUUUUCUUUUAAGAUCtg-3' | (SEQ ID NO: 1524) | |
| | 3'-<u>CUA</u>AAACAAAAAAGAAAAUUCUAGAC-5' | (SEQ ID NO: 1929) | |
| AR-838 Target: | 5'-GATTTTGTTTTTTCTTTTAAGATCTG-3' | (SEQ ID NO: 2334) | |
| | 5'-UUUUUUCUUUUAAGAUCUGGGCAtc-3' | (SEQ ID NO: 1525) | |
| | 3'-<u>CAA</u>AAAAAGAAAAUUCUAGACCCGUAG-5' | (SEQ ID NO: 1930) | |
| AR-844 Target: | 5'-GTTTTTTTCTTTTAAGATCTGGGCATC-3' | (SEQ ID NO: 2335) | |
| | 5'-GCAUCUUUUGAAUCUACCCUUCAag-3' | (SEQ ID NO: 1526) | |
| | 3'-<u>CCC</u>GUAGAAAACUUAGAUGGGAAGUUC-5' | (SEQ ID NO: 1931) | |
| AR-864 Target: | 5'-GGGCATCTTTTGAATCTACCCTTCAAG-3' | (SEQ ID NO: 2336) | |
| | 5'-GAGCGCUUUUUGCGUGGUUGCUCcc-3' | (SEQ ID NO: 1527) | |
| | 3'-<u>GUC</u>UCGCGAAAAACGCACCAACGAGGG-5' | (SEQ ID NO: 1932) | |
| AR-971 Target: | 5'-CAGAGCGCTTTTTGCGTGGTTGCTCCC-3' | (SEQ ID NO: 2337) | |
| | 5'-CUUUUUGCGUGGUUGCUCCCGCAag-3' | (SEQ ID NO: 1528) | |
| | 3'-<u>GCG</u>AAAAACGCACCAACGAGGGCGUUC-5' | (SEQ ID NO: 1933) | |
| AR-976 Target: | 5'-CGCTTTTTGCGTGGTTGCTCCCGCAAG-3' | (SEQ ID NO: 2338) | |
| | 5'-GUUUCCUUCUCUGGAGCUUCCCGca-3' | (SEQ ID NO: 1529) | |
| | 3'-<u>UUC</u>AAAGGAAGAGACCUCGAAGGGCGU-5' | (SEQ ID NO: 1934) | |
| AR-1000 Target: | 5'-AAGTTTCCTTCTCTGGAGCTTCCCGCA-3' | (SEQ ID NO: 2339) | |
| | 5'-CUUCCCGCAGGUGGGCAGCUAGCtg-3' | (SEQ ID NO: 1530) | |
| | 3'-<u>UCG</u>AAGGGCGUCCACCCGUCGAUCGAC-5' | (SEQ ID NO: 1935) | |
| AR-1016 Target: | 5'-AGCTTCCCGCAGGTGGGCAGCTAGCTG-3' | (SEQ ID NO: 2340) | |
| | 5'-GGGCAGCUAGCUGCAGCGACUACcg-3' | (SEQ ID NO: 1531) | |
| | 3'-<u>CAC</u>CCGUCGAUCGACGUCGCUGAUGGC-5' | (SEQ ID NO: 1936) | |
| AR-1028 Target: | 5'-GTGGGCAGCTAGCTGCAGCGACTACCG-3' | (SEQ ID NO: 2341) | |
| | 5'-GUGCAGUUAGGGCUGGGAAGGGUct-3' | (SEQ ID NO: 1532) | |
| | 3'-<u>UUC</u>ACGUCAAUCCCGACCCUUCCCAGA-5' | (SEQ ID NO: 1937) | |
| AR-1146 Target: | 5'-AAGTGCAGTTAGGGCTGGGAAGGGTCT-3' | (SEQ ID NO: 2342) | |
| | 5'-UGCAGUUAGGGCUGGGAAGGGUCta-3' | (SEQ ID NO: 1533) | |
| | 3'-<u>UCA</u>CGUCAAUCCCGACCCUUCCCAGAU-5' | (SEQ ID NO: 1938) | |
| AR-1147 Target: | 5'-AGTGCAGTTAGGGCTGGGAAGGGTCTA-3' | (SEQ ID NO: 2343) | |
| | 5'-GCAGUUAGGGCUGGGAAGGGUCUac-3' | (SEQ ID NO: 1534) | |
| | 3'-<u>CAC</u>GUCAAUCCCGACCCUUCCCAGAUG-5' | (SEQ ID NO: 1939) | |
| AR-1148 Target: | 5'-GTGCAGTTAGGGCTGGGAAGGGTCTAC-3' | (SEQ ID NO: 2344) | |
| | 5'-CAGUUAGGGCUGGGAAGGGUCUAcc-3' | (SEQ ID NO: 1535) | |
| | 3'-<u>ACG</u>UCAAUCCCGACCCUUCCCAGAUGG-5' | (SEQ ID NO: 1940) | |
| AR-1149 Target: | 5'-TGCAGTTAGGGCTGGGAAGGGTCTACC-3' | (SEQ ID NO: 2345) | |
| | 5'-AGUUAGGGCUGGGAAGGGUCUACcc-3' | (SEQ ID NO: 1536) | |
| | 3'-<u>CGU</u>CAAUCCCGACCCUUCCCAGAUGGG-5' | (SEQ ID NO: 1941) | |
| AR-1150 Target: | 5'-GCAGTTAGGGCTGGGAAGGGTCTACCC-3' | (SEQ ID NO: 2346) | |
| | 5'-GUUAGGGCUGGGAAGGGUCUACCct-3' | (SEQ ID NO: 1537) | |
| | 3'-<u>GUC</u>AAUCCCGACCCUUCCCAGAUGGGA-5' | (SEQ ID NO: 1942) | |
| AR-1151 Target: | 5'-CAGTTAGGGCTGGGAAGGGTCTACCCT-3' | (SEQ ID NO: 2347) | |
| | 5'-UUAGGGCUGGGAAGGGUCUACCCtc-3' | (SEQ ID NO: 1538) | |
| | 3'-<u>UCA</u>AUCCCGACCCUUCCCAGAUGGGAG-5' | (SEQ ID NO: 1943) | |

TABLE 9-continued

AR Tested Duplexes, Human

```
AR-1152 Target:  5'-AGTTAGGGCTGGGAAGGGTCTACCCTC-3'    (SEQ ID NO: 2348)

5'-UAGGGCUGGGAAGGGUCUACCCUcg-3'     (SEQ ID NO: 1539)
                 3'-CAAUCCCGACCCUUCCCAGAUGGGAGC-5'   (SEQ ID NO: 1944)

AR-1153 Target:  5'-GTTAGGGCTGGGAAGGGTCTACCCTCG-3'    (SEQ ID NO: 2349)

5'-AGGGCUGGGAAGGGUCUACCCUCgg-3'     (SEQ ID NO: 1540)
                 3'-AAUCCCGACCCUUCCCAGAUGGGAGCC-5'   (SEQ ID NO: 1945)

AR-1154 Target:  5'-TTAGGGCTGGGAAGGGTCTACCCTCGG-3'    (SEQ ID NO: 2350)

5'-GGGCUGGGAAGGGUCUACCCUCGgc-3'     (SEQ ID NO: 1541)
                 3'-AUCCCGACCCUUCCCAGAUGGGAGCCG-5'   (SEQ ID NO: 1946)

AR-1155 Target:  5'-TAGGGCTGGGAAGGGTCTACCCTCGGC-3'    (SEQ ID NO: 2351)

5'-GGCUGGGAAGGGUCUACCCUCGGcc-3'     (SEQ ID NO: 1542)
                 3'-UCCCGACCCUUCCCAGAUGGGAGCCGG-5'   (SEQ ID NO: 1947)

AR-1156 Target:  5'-AGGGCTGGGAAGGGTCTACCCTCGGCC-3'    (SEQ ID NO: 2352)

5'-UUCCAGAAUCUGUUCCAGAGCGUgc-3'     (SEQ ID NO: 1543)
                 3'-GAAAGGUCUUAGACAAGGUCUCGCACG-5'   (SEQ ID NO: 1948)

AR-1206 Target:  5'-CTTTCCAGAATCTGTTCCAGAGCGTGC-3'    (SEQ ID NO: 2353)

5'-UCCAGAAUCUGUUCCAGAGCGUGcg-3'     (SEQ ID NO: 1544)
                 3'-AAAGGUCUUAGACAAGGUCUCGCACGC-5'   (SEQ ID NO: 1949)

AR-1207 Target:  5'-TTTCCAGAATCTGTTCCAGAGCGTGCG-3'    (SEQ ID NO: 2354)

5'-CCAGAAUCUGUUCCAGAGCGUGCgc-3'     (SEQ ID NO: 1545)
                 3'-AAGGUCUUAGACAAGGUCUCGCACGCG-5'   (SEQ ID NO: 1950)

AR-1208 Target:  5'-TTCCAGAATCTGTTCCAGAGCGTGCGC-3'    (SEQ ID NO: 2355)

5'-CAGAAUCUGUUCCAGAGCGUGCGcg-3'     (SEQ ID NO: 1546)
                 3'-AGGUCUUAGACAAGGUCUCGCACGCGC-5'   (SEQ ID NO: 1951)

AR-1209 Target:  5'-TCCAGAATCTGTTCCAGAGCGTGCGCG-3'    (SEQ ID NO: 2356)

5'-AGAAUCUGUUCCAGAGCGUGCGCga-3'    (SEQ ID NO: 1547)
                 3'-GGUCUUAGACAAGGUCUCGCACGCGCU-5'  (SEQ ID NO: 1952)

AR-1210 Target:  5'-CCAGAATCTGTTCCAGAGCGTGCGCGA-3'    (SEQ ID NO: 2357)

5'-GAAUCUGUUCCAGAGCGUGCGCGaa-3'    (SEQ ID NO: 1548)
                 3'-GUCUUAGACAAGGUCUCGCACGCGCUU-5'  (SEQ ID NO: 1953)

AR-1211 Target:  5'-CAGAATCTGTTCCAGAGCGTGCGCGAA-3'    (SEQ ID NO: 2358)

5'-AAUCUGUUCCAGAGCGUGCGCGAag-3'    (SEQ ID NO: 1549)
                 3'-UCUUAGACAAGGUCUCGCACGCGCUUC-5'  (SEQ ID NO: 1954)

AR-1212 Target:  5'-AGAATCTGTTCCAGAGCGTGCGCGAAG-3'    (SEQ ID NO: 2359)

5'-AUCUGUUCCAGAGCGUGCGCGAAgt-3'    (SEQ ID NO: 1550)
                 3'-CUUAGACAAGGUCUCGCACGCGCUUCA-5'  (SEQ ID NO: 1955)

AR-1213 Target:  5'-GAATCTGTTCCAGAGCGTGCGCGAAGT-3'    (SEQ ID NO: 2360)

5'-UCUGUUCCAGAGCGUGCGCGAAGtg-3'    (SEQ ID NO: 1551)
                 3'-UUAGACAAGGUCUCGCACGCGCUUCAC-5'  (SEQ ID NO: 1956)

AR-1214 Target:  5'-AATCTGTTCCAGAGCGTGCGCGAAGTG-3'    (SEQ ID NO: 2361)

5'-CUGUUCCAGAGCGUGCGCGAAGUga-3'    (SEQ ID NO: 1552)
                 3'-UAGACAAGGUCUCGCACGCGCUUCACU-5'  (SEQ ID NO: 1957)

AR-1215 Target:  5'-ATCTGTTCCAGAGCGTGCGCGAAGTGA-3'    (SEQ ID NO: 2362)

5'-UGUUCCAGAGCGUGCGCGAAGUGat-3'    (SEQ ID NO: 1553)
                 3'-AGACAAGGUCUCGCACGCGCUUCACUA-5'  (SEQ ID NO: 1958)
```

TABLE 9-continued

AR Tested Duplexes, Human

| | | |
|---|---|---|
| AR-1216 Target: | 5'-TCTGTTCCAGAGCGTGCGCGAAGTGAT-3' | (SEQ ID NO: 2363) |
| | 5'-GUUCCAGAGCGUGCGCGAAGUGAtc-3' | (SEQ ID NO: 1554) |
| | 3'-GACAAGGUCUCGCACGCGCUUCACUAG-5' | (SEQ ID NO: 1959) |
| AR-1217 Target: | 5'-CTGTTCCAGAGCGTGCGCGAAGTGATC-3' | (SEQ ID NO: 2364) |
| | 5'-UUCCAGAGCGUGCGCGAAGUGAUcc-3' | (SEQ ID NO: 1555) |
| | 3'-ACAAGGUCUCGCACGCGCUUCACUAGG-5' | (SEQ ID NO: 1960) |
| AR-1218 Target: | 5'-TGTTCCAGAGCGTGCGCGAAGTGATCC-3' | (SEQ ID NO: 2365) |
| | 5'-CGCCAGUUUGCUGCUGCUGCAGCag-3' | (SEQ ID NO: 1556) |
| | 3'-CCGCGGUCAAACGACGACGACGUCGUC-5' | (SEQ ID NO: 1961) |
| AR-1292 Target: | 5'-GGCGCCAGTTTGCTGCTGCTGCAGCAG-3' | (SEQ ID NO: 2366) |
| | 5'-GCUGCUGCUGCAGCAGCAGCAGCag-3' | (SEQ ID NO: 1557) |
| | 3'-AACGACGACGACGUCGUCGUCGUCGUC-5' | (SEQ ID NO: 1962) |
| AR-1301 Target: | 5'-TTGCTGCTGCTGCAGCAGCAGCAGCAG-3' | (SEQ ID NO: 2367) |
| | 5'-GUCCCAGAGCCUGGAGCCGCCGUgg-3' | (SEQ ID NO: 1558) |
| | 3'-CGCAGGGUCUCGGACCUCGGCGGCACC-5' | (SEQ ID NO: 1963) |
| AR-1533 Target: | 5'-GCGTCCCAGAGCCTGGAGCCGCCGTGG-3' | (SEQ ID NO: 2368) |
| | 5'-CUGCCGCAGCAGCUGCCAGCACCtc-3' | (SEQ ID NO: 1559) |
| | 3'-CCGACGGCGUCGUCGACGGUCGUGGAG-5' | (SEQ ID NO: 1964) |
| AR-1572 Target: | 5'-GGCTGCCGCAGCAGCTGCCAGCACCTC-3' | (SEQ ID NO: 2369) |
| | 5'-CAGCAGCUGCCAGCACCUCCGGAcg-3' | (SEQ ID NO: 1560) |
| | 3'-GCGUCGUCGACGGUCGUGGAGGCCUGC-5' | (SEQ ID NO: 1965) |
| AR-1578 Target: | 5'-CGCAGCAGCTGCCAGCACCTCCGGACG-3' | (SEQ ID NO: 2370) |
| | 5'-CAUCCACGUUGUCCCUGCUGGGCcc-3' | (SEQ ID NO: 1561) |
| | 3'-GGGUAGGUGCAACAGGGACGACCCGGG-5' | (SEQ ID NO: 1966) |
| AR-1621 Target: | 5'-CCCATCCACGTTGTCCCTGCTGGGCCC-3' | (SEQ ID NO: 2371) |
| | 5'-GGCUUAAGCAGCUGCUCCGCUGAcc-3' | (SEQ ID NO: 1562) |
| | 3'-GGCCGAAUUCGUCGACGAGGCGACUGG-5' | (SEQ ID NO: 1967) |
| AR-1656 Target: | 5'-CCGGCTTAAGCAGCTGCTCCGCTGACC-3' | (SEQ ID NO: 2372) |
| | 5'-GCUUAAGCAGCUGCUCCGCUGACct-3' | (SEQ ID NO: 1563) |
| | 3'-GCCGAAUUCGUCGACGAGGCGACUGGA-5' | (SEQ ID NO: 1968) |
| AR-1657 Target: | 5'-CGGCTTAAGCAGCTGCTCCGCTGACCT-3' | (SEQ ID NO: 2373) |
| | 5'-AGCAGCUGCUCCGCUGACCUUAAag-3' | (SEQ ID NO: 1564) |
| | 3'-AUUCGUCGACGAGGCGACUGGAAUUUC-5' | (SEQ ID NO: 1969) |
| AR-1662 Target: | 5'-TAAGCAGCTGCTCCGCTGACCTTAAAG-3' | (SEQ ID NO: 2374) |
| | 5'-GCAACUCCUUCAGCAACAGCAGCag-3' | (SEQ ID NO: 1565) |
| | 3'-UACGUUGAGGAAGUCGUUGUCGUCGUC-5' | (SEQ ID NO: 1970) |
| AR-1712 Target: | 5'-ATGCAACTCCTTCAGCAACAGCAGCAG-3' | (SEQ ID NO: 2375) |
| | 5'-CAUUUCUGACAACGCCAAGGAGUtg-3' | (SEQ ID NO: 1566) |
| | 3'-UGGUAAAGACUGUUGCGGUUCCUCAAC-5' | (SEQ ID NO: 1971) |
| AR-1832 Target: | 5'-ACCATTTCTGACAACGCCAAGGAGTTG-3' | (SEQ ID NO: 2376) |
| | 5'-ACUUUUGGGAGUUCCACCCGCUGtg-3' | (SEQ ID NO: 1567) |
| | 3'-GGUGAAAACCCUCAAGGUGGGCGACAC-5' | (SEQ ID NO: 1972) |
| AR-1952 Target: | 5'-CCACTTTTGGGAGTTCCACCCGCTGTG-3' | (SEQ ID NO: 2377) |
| | 5'-GGCAAGAGCACUGAAGAUACUGCtg-3' | (SEQ ID NO: 1568) |
| | 3'-GUCCGUUCUCGUGACUUCUAUGACGAC-5' | (SEQ ID NO: 1973) |

TABLE 9-continued

AR Tested Duplexes, Human

```
AR-2037 Target:  5'-CAGGCAAGAGCACTGAAGATACTGCTG-3'    (SEQ ID NO: 2378)

5'-GGCAGCGCUGCAGCAGGGAGCUCcg-3'     (SEQ ID NO: 1569)
                 3'-GACCGUCGCGACGUCGUCCCUCGAGGC-5'   (SEQ ID NO: 1974)

AR-2124 Target:  5'-CTGGCAGCGCTGCAGCAGGGAGCTCCG-3'   (SEQ ID NO: 2379)

5'-UCGCGACUACUACAACUUUCCACtg-3'     (SEQ ID NO: 1570)
                 3'-UCAGCGCUGAUGAUGUUGAAAGGUGAC-5'   (SEQ ID NO: 1975)

AR-2222 Target:  5'-AGTCGCGACTACTACAACTTTCCACTG-3'   (SEQ ID NO: 2380)

5'-CGCGACUACUACAACUUUCCACUgg-3'     (SEQ ID NO: 1571)
                 3'-CAGCGCUGAUGAUGUUGAAAGGUGACC-5'   (SEQ ID NO: 1976)

AR-2223 Target:  5'-GTCGCGACTACTACAACTTTCCACTGG-3'   (SEQ ID NO: 2381)

5'-GCGACUACUACAACUUCCACUGgc-3'      (SEQ ID NO: 1572)
                 3'-AGCGCUGAUGAUGUUGAAAGGUGACCG-5'   (SEQ ID NO: 1977)

AR-2224 Target:  5'-TCGCGACTACTACAACTTTCCACTGGC-3'   (SEQ ID NO: 2382)

5'-UCGCAUCAAGCUGGAGAACCCGCtg-3'     (SEQ ID NO: 1573)
                 3'-CGAGCGUAGUUCGACCUCUUGGGCGAC-5'   (SEQ ID NO: 1978)

AR-2294 Target:  5'-GCTCGCATCAAGCTGGAGAACCCGCTG-3'   (SEQ ID NO: 2383)

5'-UGGACUACGGCAGCGCCUGGGCGgc-3'     (SEQ ID NO: 1574)
                 3'-CGACCUGAUGCCGUCGCGGACCCGCCG-5'   (SEQ ID NO: 1979)

AR-2317 Target:  5'-GCTGGACTACGGCAGCGCCTGGGCGGC-3'   (SEQ ID NO: 2384)

5'-GGACUACGGCAGCGCCUGGGCGGct-3'     (SEQ ID NO: 1575)
                 3'-GACCUGAUGCCGUCGCGGACCCGCCGA-5'   (SEQ ID NO: 1980)

AR-2318 Target:  5'-CTGGACTACGGCAGCGCCTGGGCGGCT-3'   (SEQ ID NO: 2385)

5'-GACUACGGCAGCGCCUGGGCGGCtg-3'     (SEQ ID NO: 1576)
                 3'-ACCUGAUGCCGUCGCGGACCCGCCGAC-5'   (SEQ ID NO: 1981)

AR-2319 Target:  5'-TGGACTACGGCAGCGCCTGGGCGGCTG-3'   (SEQ ID NO: 2386)

5'-ACUACGGCAGCGCCUGGGCGGCUgc-3'     (SEQ ID NO: 1577)
                 3'-CCUGAUGCCGUCGCGGACCCGCCGACG-5'   (SEQ ID NO: 1982)

AR-2320 Target:  5'-GGACTACGGCAGCGCCTGGGCGGCTGC-3'   (SEQ ID NO: 2387)

5'-GCGCGGGUGCAGCGGGACCCGGUtc-3'     (SEQ ID NO: 1578)
                 3'-ACCGCGCCCACGUCGCCCUGGGCCAAG-5'   (SEQ ID NO: 1983)

AR-2386 Target:  5'-TGGCGCGGGTGCAGCGGGACCCGGTTC-3'   (SEQ ID NO: 2388)

5'-CUGGCGGGCCAGGAAAGCGACUUca-3'     (SEQ ID NO: 1579)
                 3'-CCGACCGCCCGGUCCUUUCGCUGAAGU-5'   (SEQ ID NO: 1984)

AR-2607 Target:  5'-GGCTGGCGGGCCAGGAAAGCGACTTCA-3'   (SEQ ID NO: 2389)

5'-ACCCUGGCGGCAUGGUGAGCAGAgt-3'     (SEQ ID NO: 1580)
                 3'-CAUGGGACCGCCGUACCACUCGUCUCA-5'   (SEQ ID NO: 1985)

AR-2650 Target:  5'-GTACCCTGGCGGCATGGTGAGCAGAGT-3'   (SEQ ID NO: 2390)

5'-GAUGGAUAGCUACUCCGGACCUUac-3'     (SEQ ID NO: 1581)
                 3'-ACCUACCUAUCGAUGAGGCCUGGAAUG-5'   (SEQ ID NO: 1986)

AR-2720 Target:  5'-TGGATGGATAGCTACTCCGGACCTTAC-3'   (SEQ ID NO: 2391)

5'-CAGAAGACCUGCCUGAUCUGUGGag-3'     (SEQ ID NO: 1582)
                 3'-GGGUCUUCUGGACGGACUAGACACCUC-5'   (SEQ ID NO: 1987)

AR-2808 Target:  5'-CCCAGAAGACCTGCCTGATCTGTGGAG-3'   (SEQ ID NO: 2392)

5'-AGAAGACCUGCCUGAUCUGUGGAga-3'     (SEQ ID NO: 1583)
                 3'-GGUCUUCUGGACGGACUAGACACCUCU-5'   (SEQ ID NO: 1988)
```

TABLE 9-continued

AR Tested Duplexes, Human

```
AR-2809 Target:  5'-CCAGAAGACCTGCCTGATCTGTGGAGA-3'      (SEQ ID NO: 2393)

5'-GAAGACCUGCCUGAUCUGUGGAGat-3'       (SEQ ID NO: 1584)
                 3'-GUCUUCUGGACGGACUAGACACCUCUA-5'     (SEQ ID NO: 1989)

AR-2810 Target:  5'-CAGAAGACCTGCCTGATCTGTGGAGAT-3'     (SEQ ID NO: 2394)

5'-AAGACCUGCCUGAUCUGUGGAGAtg-3'       (SEQ ID NO: 1585)
                 3'-UCUUCUGGACGGACUAGACACCUCUAC-5'    (SEQ ID NO: 1990)

AR-2811 Target:  5'-AGAAGACCTGCCTGATCTGTGGAGATG-3'     (SEQ ID NO: 2395)

5'-AGACCUGCCUGAUCUGUGGAGAUga-3'       (SEQ ID NO: 1586)
                 3'-CUUCUGGACGGACUAGACACCUCUACU-5'    (SEQ ID NO: 1991)

AR-2812 Target:  5'-GAAGACCTGCCTGATCTGTGGAGATGA-3'     (SEQ ID NO: 2396)

5'-GACCUGCCUGAUCUGUGGAGAUGaa-3'       (SEQ ID NO: 1587)
                 3'-UUCUGGACGGACUAGACACCUCUACUU-5'    (SEQ ID NO: 1992)

AR-2813 Target:  5'-AAGACCTGCCTGATCTGTGGAGATGAA-3'     (SEQ ID NO: 2397)

5'-ACCUGCCUGAUCUGUGGAGAUGAag-3'       (SEQ ID NO: 1588)
                 3'-UCUGGACGGACUAGACACCUCUACUUC-5'    (SEQ ID NO: 1993)

AR-2814 Target:  5'-AGACCTGCCTGATCTGTGGAGATGAAG-3'     (SEQ ID NO: 2398)

5'-CCUGCCUGAUCUGUGGAGAUGAAgc-3'       (SEQ ID NO: 1589)
                 3'-CUGGACGGACUAGACACCUCUACUUCG-5'    (SEQ ID NO: 1994)

AR-2815 Target:  5'-GACCTGCCTGATCTGTGGAGATGAAGC-3'     (SEQ ID NO: 2399)

5'-CUGCCUGAUCUGUGGAGAUGAAGct-3'       (SEQ ID NO: 1590)
                 3'-UGGACGGACUAGACACCUCUACUUCGA-5'    (SEQ ID NO: 1995)

AR-2816 Target:  5'-ACCTGCCTGATCTGTGGAGATGAAGCT-3'     (SEQ ID NO: 2400)

5'-UGCCUGAUCUGUGGAGAUGAAGCtt-3'       (SEQ ID NO: 1591)
                 3'-GGACGGACUAGACACCUCUACUUCGAA-5'    (SEQ ID NO: 1996)

AR-2817 Target:  5'-CCTGCCTGATCTGTGGAGATGAAGCTT-3'     (SEQ ID NO: 2401)

5'-GCCUGAUCUGUGGAGAUGAAGCUtc-3'       (SEQ ID NO: 1592)
                 3'-GACGGACUAGACACCUCUACUUCGAAG-5'    (SEQ ID NO: 1997)

AR-2818 Target:  5'-CTGCCTGATCTGTGGAGATGAAGCTTC-3'     (SEQ ID NO: 2402)

5'-CCUGAUCUGUGGAGAUGAAGCUUct-3'       (SEQ ID NO: 1593)
                 3'-ACGGACUAGACACCUCUACUUCGAAGA-5'    (SEQ ID NO: 1998)

AR-2819 Target:  5'-TGCCTGATCTGTGGAGATGAAGCTTCT-3'     (SEQ ID NO: 2403)

5'-CUGAUCUGUGGAGAUGAAGCUUCtg-3'       (SEQ ID NO: 1594)
                 3'-CGGACUAGACACCUCUACUUCGAAGAC-5'    (SEQ ID NO: 1999)

AR-2820 Target:  5'-GCCTGATCTGTGGAGATGAAGCTTCTG-3'     (SEQ ID NO: 2404)

5'-UGAUCUGUGGAGAUGAAGCUUCUgg-3'       (SEQ ID NO: 1595)
                 3'-GGACUAGACACCUCUACUUCGAAGACC-5'    (SEQ ID NO: 2000)

AR-2821 Target:  5'-CCTGATCTGTGGAGATGAAGCTTCTGG-3'     (SEQ ID NO: 2405)

5'-GAUCUGUGGAGAUGAAGCUUCUGgg-3'       (SEQ ID NO: 1596)
                 3'-GACUAGACACCUCUACUUCGAAGACCC-5'    (SEQ ID NO: 2001)

AR-2822 Target:  5'-CTGATCTGTGGAGATGAAGCTTCTGGG-3'     (SEQ ID NO: 2406)

5'-AUCUGUGGAGAUGAAGCUUCUGGgt-3'       (SEQ ID NO: 1597)
                 3'-ACUAGACACCUCUACUUCGAAGACCCA-5'    (SEQ ID NO: 2002)

AR-2823 Target:  5'-TGATCTGTGGAGATGAAGCTTCTGGGT-3'     (SEQ ID NO: 2407)

5'-UCUGUGGAGAUGAAGCUUCUGGGtg-3'       (SEQ ID NO: 1598)
                 3'-CUAGACACCUCUACUUCGAAGACCCAC-5'    (SEQ ID NO: 2003)
```

TABLE 9-continued

AR Tested Duplexes, Human

```
AR-2824 Target:  5'-GATCTGTGGAGATGAAGCTTCTGGGTG-3'   (SEQ ID NO: 2408)

5'-CUGUGGAGAUGAAGCUUCUGGGUGgt-3'    (SEQ ID NO: 1599)
                 3'-UAGACACCUCUACUUCGAAGACCCACA-5'   (SEQ ID NO: 2004)

AR-2825 Target:  5'-ATCTGTGGAGATGAAGCTTCTGGGTGT-3'   (SEQ ID NO: 2409)

5'-UGUGGAGAUGAAGCUUCUGGGUGtc-3'    (SEQ ID NO: 1600)
                 3'-AGACACCUCUACUUCGAAGACCCACAG-5'   (SEQ ID NO: 2005)

AR-2826 Target:  5'-TCTGTGGAGATGAAGCTTCTGGGTGTC-3'   (SEQ ID NO: 2410)

5'-GUGGAGAUGAAGCUUCUGGGUGUca-3'    (SEQ ID NO: 1601)
                 3'-GACACCUCUACUUCGAAGACCCACAGU-5'   (SEQ ID NO: 2006)

AR-2827 Target:  5'-CTGTGGAGATGAAGCTTCTGGGTGTCA-3'   (SEQ ID NO: 2411)

5'-UUCUGGGUGUCACUAUGGAGCUCtc-3'    (SEQ ID NO: 1602)
                 3'-CGAAGACCCACAGUGAUACCUCGAGAG-5'   (SEQ ID NO: 2007)

AR-2840 Target:  5'-GCTTCTGGGTGTCACTATGGAGCTCTC-3'   (SEQ ID NO: 2412)

5'-GAGCUCUCACAUGUGGAAGCUGCaa-3'    (SEQ ID NO: 1603)
                 3'-ACCUCGAGAGUGUACACCUUCGACGUU-5'   (SEQ ID NO: 2008)

AR-2857 Target:  5'-TGGAGCTCTCACATGTGGAAGCTGCAA-3'   (SEQ ID NO: 2413)

5'-AGCUGCAAGGUCUUCUUCAAAAGag-3'    (SEQ ID NO: 1604)
                 3'-CUUCGACGUUCCAGAAGAAGUUUUCUC-5'   (SEQ ID NO: 2009)

AR-2874 Target:  5'-GAAGCTGCAAGGTCTTCTTCAAAAGAG-3'   (SEQ ID NO: 2414)

5'-GCUGCAAGGUCUUCUUCAAAAGAgc-3'    (SEQ ID NO: 1605)
                 3'-UUCGACGUUCCAGAAGAAGUUUUCUCG-5'   (SEQ ID NO: 2010)

AR-2875 Target:  5'-AAGCTGCAAGGTCTTCTTCAAAAGAGC-3'   (SEQ ID NO: 2415)

5'-CUGCAAGGUCUUCUUCAAAAGAGcc-3'    (SEQ ID NO: 1606)
                 3'-UCGACGUUCCAGAAGAAGUUUUCUCGG-5'   (SEQ ID NO: 2011)

AR-2876 Target:  5'-AGCTGCAAGGTCTTCTTCAAAAGAGCC-3'   (SEQ ID NO: 2416)

5'-UGCAAGGUCUUCUUCAAAAGAGCcg-3'    (SEQ ID NO: 1607)
                 3'-CGACGUUCCAGAAGAAGUUUUCUCGGC-5'   (SEQ ID NO: 2012)

AR-2877 Target:  5'-GCTGCAAGGTCTTCTTCAAAAGAGCCG-3'   (SEQ ID NO: 2417)

5'-GCAAGGUCUUCUUCAAAAGAGCCgc-3'    (SEQ ID NO: 1608)
                 3'-GACGUUCCAGAAGAAGUUUUCUCGGCG-5'   (SEQ ID NO: 2013)

AR-2878 Target:  5'-CTGCAAGGTCTTCTTCAAAAGAGCCGC-3'   (SEQ ID NO: 2418)

5'-CAAGGUCUUCUUCAAAAGAGCCGct-3'    (SEQ ID NO: 1609)
                 3'-ACGUUCCAGAAGAAGUUUUCUCGGCGA-5'   (SEQ ID NO: 2014)

AR-2879 Target:  5'-TGCAAGGTCTTCTTCAAAAGAGCCGCT-3'   (SEQ ID NO: 2419)

5'-AAGGUCUUCUUCAAAAGAGCCGCtg-3'    (SEQ ID NO: 1610)
                 3'-CGUUCCAGAAGAAGUUUUCUCGGCGAC-5'   (SEQ ID NO: 2015)

AR-2880 Target:  5'-GCAAGGTCTTCTTCAAAAGAGCCGCTG-3'   (SEQ ID NO: 2420)

5'-AGGUCUUCUUCAAAAGAGCCGCUGa-3'    (SEQ ID NO: 1611)
                 3'-GUUCCAGAAGAAGUUUUCUCGGCGACU-5'   (SEQ ID NO: 2016)

AR-2881 Target:  5'-CAAGGTCTTCTTCAAAAGAGCCGCTGA-3'   (SEQ ID NO: 2421)

5'-GGUCUUCUUCAAAAGAGCCGCUGaa-3'    (SEQ ID NO: 1612)
                 3'-UUCCAGAAGAAGUUUUCUCGGCGACUU-5'   (SEQ ID NO: 2017)

AR-2882 Target:  5'-AAGGTCTTCTTCAAAAGAGCCGCTGAA-3'   (SEQ ID NO: 2422)

5'-GUCUUCUUCAAAAGAGCCGCUGAag-3'    (SEQ ID NO: 1613)
                 3'-UCCAGAAGAAGUUUUCUCGGCGACUUC-5'   (SEQ ID NO: 2018)
```

TABLE 9-continued

AR Tested Duplexes, Human

```
AR-2883 Target:  5'-AGGTCTTCTTCAAAAGAGCCGCTGAAG-3'       (SEQ ID NO: 2423)

5'-UCUUCUUCAAAAGAGCCGCUGAAgg-3'         (SEQ ID NO: 1614)
                 3'-CCAGAAGAAGUUUUCUCGGCGACUUCC-5'       (SEQ ID NO: 2019)

AR-2884 Target:  5'-GGTCTTCTTCAAAAGAGCCGCTGAAGG-3'       (SEQ ID NO: 2424)

5'-CUUCUUCAAAAGAGCCGCUGAAGgg-3'         (SEQ ID NO: 1615)
                 3'-CAGAAGAAGUUUUCUCGGCGACUUCCC-5'      (SEQ ID NO: 2020)

AR-2885 Target:  5'-GTCTTCTTCAAAAGAGCCGCTGAAGGG-3'       (SEQ ID NO: 2425)

5'-UUCUUCAAAAGAGCCGCUGAAGGga-3'         (SEQ ID NO: 1616)
                 3'-AGAAGAAGUUUUCUCGGCGACUUCCCU-5'      (SEQ ID NO: 2021)

AR-2886 Target:  5'-TCTTCTTCAAAAGAGCCGCTGAAGGGA-3'       (SEQ ID NO: 2426)

5'-UCUUCAAAAGAGCCGCUGAAGGGaa-3'         (SEQ ID NO: 1617)
                 3'-GAAGAAGUUUUCUCGGCGACUUCCCUU-5'      (SEQ ID NO: 2022)

AR-2887 Target:  5'-CTTCTTCAAAAGAGCCGCTGAAGGGAA-3'       (SEQ ID NO: 2427)

5'-CUUCAAAAGAGCCGCUGAAGGGAaa-3'         (SEQ ID NO: 1618)
                 3'-AAGAAGUUUUCUCGGCGACUUCCCUUU-5'      (SEQ ID NO: 2023)

AR-2888 Target:  5'-TTCTTCAAAAGAGCCGCTGAAGGGAAA-3'       (SEQ ID NO: 2428)

5'-UUCAAAAGAGCCGCUGAAGGGAAac-3'         (SEQ ID NO: 1619)
                 3'-AGAAGUUUUCUCGGCGACUUCCCUUUG-5'      (SEQ ID NO: 2024)

AR-2889 Target:  5'-TCTTCAAAAGAGCCGCTGAAGGGAAAC-3'       (SEQ ID NO: 2429)

5'-UCAAAAGAGCCGCUGAAGGGAAAca-3'         (SEQ ID NO: 1620)
                 3'-GAAGUUUUCUCGGCGACUUCCCUUUGU-5'      (SEQ ID NO: 2025)

AR-2890 Target:  5'-CTTCAAAAGAGCCGCTGAAGGGAAACA-3'       (SEQ ID NO: 2430)

5'-CAAAAGAGCCGCUGAAGGGAAACag-3'         (SEQ ID NO: 1621)
                 3'-AAGUUUUCUCGGCGACUUCCCUUUGUC-5'      (SEQ ID NO: 2026)

AR-2891 Target:  5'-TTCAAAAGAGCCGCTGAAGGGAAACAG-3'       (SEQ ID NO: 2431)

5'-AAAAGAGCCGCUGAAGGGAAACAga-3'         (SEQ ID NO: 1622)
                 3'-AGUUUUCUCGGCGACUUCCCUUUGUCU-5'      (SEQ ID NO: 2027)

AR-2892 Target:  5'-TCAAAAGAGCCGCTGAAGGGAAACAGA-3'       (SEQ ID NO: 2432)

5'-AAAGAGCCGCUGAAGGGAAACAGaa-3'         (SEQ ID NO: 1623)
                 3'-GUUUUCUCGGCGACUUCCCUUUGUCUU-5'      (SEQ ID NO: 2028)

AR-2893 Target:  5'-CAAAAGAGCCGCTGAAGGGAAACAGAA-3'       (SEQ ID NO: 2433)

5'-AAGAGCCGCUGAAGGGAAACAGAag-3'         (SEQ ID NO: 1624)
                 3'-UUUUCUCGGCGACUUCCCUUUGUCUUC-5'      (SEQ ID NO: 2029)

AR-2894 Target:  5'-AAAAGAGCCGCTGAAGGGAAACAGAAG-3'       (SEQ ID NO: 2434)

5'-AGAGCCGCUGAAGGGAAACAGAAgt-3'         (SEQ ID NO: 1625)
                 3'-UUUCUCGGCGACUUCCCUUUGUCUUCA-5'      (SEQ ID NO: 2030)

AR-2895 Target:  5'-AAAGAGCCGCTGAAGGGAAACAGAAGT-3'       (SEQ ID NO: 2435)

5'-GAGCCGCUGAAGGGAAACAGAAGta-3'         (SEQ ID NO: 1626)
                 3'-UUCUCGGCGACUUCCCUUUGUCUUCAU-5'      (SEQ ID NO: 2031)

AR-2896 Target:  5'-AAGAGCCGCTGAAGGGAAACAGAAGTA-3'       (SEQ ID NO: 2436)

5'-AGCCGCUGAAGGGAAACAGAAGUac-3'         (SEQ ID NO: 1627)
                 3'-UCUCGGCGACUUCCCUUUGUCUUCAUG-5'      (SEQ ID NO: 2032)

AR-2897 Target:  5'-AGAGCCGCTGAAGGGAAACAGAAGTAC-3'       (SEQ ID NO: 2437)

5'-GCCGCUGAAGGGAAACAGAAGUAcc-3'         (SEQ ID NO: 1628)
                 3'-CUCGGCGACUUCCCUUUGUCUUCAUGG-5'      (SEQ ID NO: 2033)
```

TABLE 9-continued

AR Tested Duplexes, Human

```
AR-2898  Target:  5'-GAGCCGCTGAAGGGAAACAGAAGTACC-3'     (SEQ ID NO: 2438)

5'-CCGCUGAAGGGAAACAGAAGUACct-3'      (SEQ ID NO: 1629)
                  3'-UCGGCGACUUCCCUUUGUCUUCAUGGA-5'    (SEQ ID NO: 2034)

AR-2899  Target:  5'-AGCCGCTGAAGGGAAACAGAAGTACCT-3'    (SEQ ID NO: 2439)

5'-GCUGAAGGGAAACAGAAGUACCUgt-3'      (SEQ ID NO: 1630)
                  3'-GGCGACUUCCCUUUGUCUUCAUGGACA-5'    (SEQ ID NO: 2035)

AR-2901  Target:  5'-CCGCTGAAGGGAAACAGAAGTACCTGT-3'    (SEQ ID NO: 2440)

5'-CUGAAGGGAAACAGAAGUACCUGtg-3'      (SEQ ID NO: 1631)
                  3'-GCGACUUCCCUUUGUCUUCAUGGACAC-5'    (SEQ ID NO: 2036)

AR-2902  Target:  5'-CGCTGAAGGGAAACAGAAGTACCTGTG-3'    (SEQ ID NO: 2441)

5'-UGUGCGCCAGCAGAAAUGAUUGCac-3'      (SEQ ID NO: 1632)
                  3'-GGACACGCGGUCGUCUUUACUAACGUG-5'    (SEQ ID NO: 2037)

AR-2923  Target:  5'-CCTGTGCGCCAGCAGAAATGATTGCAC-3'    (SEQ ID NO: 2442)

5'-AGAAAUGAUUGCACUAUUGAUAAat-3'      (SEQ ID NO: 1633)
                  3'-CGUCUUUACUAACGUGAUAACUAUUUA-5'    (SEQ ID NO: 2038)

AR-2934  Target:  5'-GCAGAAATGATTGCACTATTGATAAAT-3'    (SEQ ID NO: 2443)

5'-UGAUUGCACUAUUGAUAAAUUCCga-3'      (SEQ ID NO: 1634)
                  3'-UUACUAACGUGAUAACUAUUUAAGGCU-5'    (SEQ ID NO: 2039)

AR-2939  Target:  5'-AATGATTGCACTATTGATAAATTCCGA-3'    (SEQ ID NO: 2444)

5'-CUAUUGAUAAAUUCCGAAGGAAAaa-3'      (SEQ ID NO: 1635)
                  3'-GUGAUAACUAUUUAAGGCUUCCUUUUU-5'    (SEQ ID NO: 2040)

AR-2947  Target:  5'-CACTATTGATAAATTCCGAAGGAAAA-3'     (SEQ ID NO: 2445)

5'-CGGAAAUGUUAUGAAGCAGGGAUga-3'      (SEQ ID NO: 1636)
                  3'-AAGCCUUUACAAUACUUCGUCCCUACU-5'    (SEQ ID NO: 2041)

AR-2991  Target:  5'-TTCGGAAATGTTATGAAGCAGGGATGA-3'    (SEQ ID NO: 2446)

5'-GGAAAUGUUAUGAAGCAGGGAUGac-3'      (SEQ ID NO: 1637)
                  3'-AGCCUUUACAAUACUUCGUCCCUACUG-5'    (SEQ ID NO: 2042)

AR-2992  Target:  5'-TCGGAAATGTTATGAAGCAGGGATGAC-3'    (SEQ ID NO: 2447)

5'-GAAAUGUUAUGAAGCAGGGAUGAct-3'      (SEQ ID NO: 1638)
                  3'-GCCUUUACAAUACUUCGUCCCUACUGA-5'    (SEQ ID NO: 2043)

AR-2993  Target:  5'-CGGAAATGTTATGAAGCAGGGATGACT-3'    (SEQ ID NO: 2448)

5'-AAAUGUUAUGAAGCAGGGAUGACtc-3'      (SEQ ID NO: 1639)
                  3'-CCUUUACAAUACUUCGUCCCUACUGAG-5'    (SEQ ID NO: 2044)

AR-2994  Target:  5'-GGAAATGTTATGAAGCAGGGATGACTC-3'    (SEQ ID NO: 2449)

5'-AAUGUUAUGAAGCAGGGAUGACUct-3'      (SEQ ID NO: 1640)
                  3'-CUUUACAAUACUUCGUCCCUACUGAGA-5'    (SEQ ID NO: 2045)

AR-2995  Target:  5'-GAAATGTTATGAAGCAGGGATGACTCT-3'    (SEQ ID NO: 2450)

5'-AUGUUAUGAAGCAGGGAUGACUCtg-3'      (SEQ ID NO: 1641)
                  3'-UUUACAAUACUUCGUCCCUACUGAGAC-5'    (SEQ ID NO: 2046)

AR-2996  Target:  5'-AAATGTTATGAAGCAGGGATGACTCTG-3'    (SEQ ID NO: 2451)

5'-UGUUAUGAAGCAGGGAUGACUCUgg-3'      (SEQ ID NO: 1642)
                  3'-UUACAAUACUUCGUCCCUACUGAGACC-5'    (SEQ ID NO: 2047)

AR-2997  Target:  5'-AATGTTATGAAGCAGGGATGACTCTGG-3'    (SEQ ID NO: 2452)

5'-GUUAUGAAGCAGGGAUGACUCUGgg-3'      (SEQ ID NO: 1643)
                  3'-UACAAUACUUCGUCCCUACUGAGACCC-5'    (SEQ ID NO: 2048)
```

TABLE 9-continued

AR Tested Duplexes, Human

```
AR-2998 Target:  5'-ATGTTATGAAGCAGGGATGACTCTGGG-3'   (SEQ ID NO: 2453)

5'-UUAUGAAGCAGGGAUGACUCUGGga-3'     (SEQ ID NO: 1644)
                 3'-ACAAUACUUCGUCCCUACUGAGACCCU-5'   (SEQ ID NO: 2049)

AR-2999 Target:  5'-TGTTATGAAGCAGGGATGACTCTGGGA-3'   (SEQ ID NO: 2454)

5'-UAUGAAGCAGGGAUGACUCUGGGag-3'    (SEQ ID NO: 1645)
                 3'-CAAUACUUCGUCCCUACUGAGACCCUC-5'   (SEQ ID NO: 2050)

AR-3000 Target:  5'-GTTATGAAGCAGGGATGACTCTGGGAG-3'   (SEQ ID NO: 2455)

5'-AUGAAGCAGGGAUGACUCUGGGAgc-3'    (SEQ ID NO: 1646)
                 3'-AAUACUUCGUCCCUACUGAGACCCUCG-5'   (SEQ ID NO: 2051)

AR-3001 Target:  5'-TTATGAAGCAGGGATGACTCTGGGAGC-3'   (SEQ ID NO: 2456)

5'-UGAAGCAGGGAUGACUCUGGGAGcc-3'    (SEQ ID NO: 1647)
                 3'-AUACUUCGUCCCUACUGAGACCCUCGG-5'   (SEQ ID NO: 2052)

AR-3002 Target:  5'-TATGAAGCAGGGATGACTCTGGGAGCC-3'   (SEQ ID NO: 2457)

5'-GAAGCAGGGAUGACUCUGGGAGCcc-3'    (SEQ ID NO: 1648)
                 3'-UACUUCGUCCCUACUGAGACCCUCGGG-5'   (SEQ ID NO: 2053)

AR-3003 Target:  5'-ATGAAGCAGGGATGACTCTGGGAGCCC-3'   (SEQ ID NO: 2458)

5'-AAGCAGGGAUGACUCUGGGAGCCcg-3'    (SEQ ID NO: 1649)
                 3'-ACUUCGUCCCUACUGAGACCCUCGGGC-5'   (SEQ ID NO: 2054)

AR-3004 Target:  5'-TGAAGCAGGGATGACTCTGGGAGCCCG-3'   (SEQ ID NO: 2459)

5'-AGCAGGGAUGACUCUGGGAGCCCgg-3'    (SEQ ID NO: 1650)
                 3'-CUUCGUCCCUACUGAGACCCUCGGGCC-5'   (SEQ ID NO: 2055)

AR-3005 Target:  5'-GAAGCAGGGATGACTCTGGGAGCCCGG-3'   (SEQ ID NO: 2460)

5'-GCAGGGAUGACUCUGGGAGCCCGga-3'    (SEQ ID NO: 1651)
                 3'-UUCGUCCCUACUGAGACCCUCGGGCCU-5'   (SEQ ID NO: 2056)

AR-3006 Target:  5'-AAGCAGGGATGACTCTGGGAGCCCGGA-3'   (SEQ ID NO: 2461)

5'-CAGGGAUGACUCUGGGAGCCCGGaa-3'    (SEQ ID NO: 1652)
                 3'-UCGUCCCUACUGAGACCCUCGGGCCUU-5'   (SEQ ID NO: 2057)

AR-3007 Target:  5'-AGCAGGGATGACTCTGGGAGCCCGGAA-3'   (SEQ ID NO: 2462)

5'-GAAGAAACUUGGUAAUCUGAAACta-3'    (SEQ ID NO: 1653)
                 3'-GACUUCUUUGAACCAUUAGACUUUGAU-5'   (SEQ ID NO: 2058)

AR-3035 Target:  5'-CTGAAGAAACTTGGTAATCTGAAACTA-3'   (SEQ ID NO: 2463)

5'-AAACUACAGGAGGAAGGAGAGGCtt-3'    (SEQ ID NO: 1654)
                 3'-ACUUUGAUGUCCUCCUUCCUCUCCGAA-5'   (SEQ ID NO: 2059)

AR-3054 Target:  5'-TGAAACTACAGGAGGAAGGAGAGGCTT-3'   (SEQ ID NO: 2464)

5'-AACUACAGGAGGAAGGAGAGGCUtc-3'    (SEQ ID NO: 1655)
                 3'-CUUUGAUGUCCUCCUUCCUCUCCGAAG-5'   (SEQ ID NO: 2060)

AR-3055 Target:  5'-GAAACTACAGGAGGAAGGAGAGGCTTC-3'   (SEQ ID NO: 2465)

5'-CAUUGAAGGCUAUGAAUGUCAGCcc-3'    (SEQ ID NO: 1656)
                 3'-GUGUAACUUCCGAUACUUACAGUCGGG-5'   (SEQ ID NO: 2061)

AR-3131 Target:  5'-CACATTGAAGGCTATGAATGTCAGCCC-3'   (SEQ ID NO: 2466)

5'-AUUGAAGGCUAUGAAUGUCAGCCca-3'    (SEQ ID NO: 1657)
                 3'-UGUAACUUCCGAUACUUACAGUCGGGU-5'   (SEQ ID NO: 2062)

AR-3132 Target:  5'-ACATTGAAGGCTATGAATGTCAGCCCA-3'   (SEQ ID NO: 2467)

5'-UUGAAGGCUAUGAAUGUCAGCCCat-3'    (SEQ ID NO: 1658)
                 3'-GUAACUUCCGAUACUUACAGUCGGGUA-5'   (SEQ ID NO: 2063)
```

TABLE 9-continued

AR Tested Duplexes, Human

```
AR-3133 Target:  5'-CATTGAAGGCTATGAATGTCAGCCCAT-3'      (SEQ ID NO: 2468)

5'-UGAAGGCUAUGAAUGUCAGCCCAtc-3'        (SEQ ID NO: 1659)
                 3'-UAACUUCCGAUACUUACAGUCGGGUAG-5'      (SEQ ID NO: 2064)

AR-3134 Target:  5'-ATTGAAGGCTATGAATGTCAGCCCATC-3'      (SEQ ID NO: 2469)

5'-GAAGGCUAUGAAUGUCAGCCCAUct-3'        (SEQ ID NO: 1660)
                 3'-AACUUCCGAUACUUACAGUCGGGUAGA-5'      (SEQ ID NO: 2065)

AR-3135 Target:  5'-TTGAAGGCTATGAATGTCAGCCCATCT-3'      (SEQ ID NO: 2470)

5'-AAGGCUAUGAAUGUCAGCCCAUCtt-3'        (SEQ ID NO: 1661)
                 3'-ACUUCCGAUACUUACAGUCGGGUAGAA-5'      (SEQ ID NO: 2066)

AR-3136 Target:  5'-TGAAGGCTATGAATGTCAGCCCATCTT-3'      (SEQ ID NO: 2471)

5'-GUCCUGGAAGCCAUUGAGCCAGGtg-3'        (SEQ ID NO: 1662)
                 3'-UACAGGACCUUCGGUAACUCGGUCCAC-5'      (SEQ ID NO: 2067)

AR-3168 Target:  5'-ATGTCCTGGAAGCCATTGAGCCAGGTG-3'      (SEQ ID NO: 2472)

5'-UCCUGGAAGCCAUUGAGCCAGGUgt-3'        (SEQ ID NO: 1663)
                 3'-ACAGGACCUUCGGUAACUCGGUCCACA-5'      (SEQ ID NO: 2068)

AR-3169 Target:  5'-TGTCCTGGAAGCCATTGAGCCAGGTGT-3'      (SEQ ID NO: 2473)

5'-CCUGGAAGCCAUUGAGCCAGGUGta-3'        (SEQ ID NO: 1664)
                 3'-CAGGACCUUCGGUAACUCGGUCCACAU-5'      (SEQ ID NO: 2069)

AR-3170 Target:  5'-GTCCTGGAAGCCATTGAGCCAGGTGTA-3'      (SEQ ID NO: 2474)

5'-CUGGAAGCCAUUGAGCCAGGUGUag-3'        (SEQ ID NO: 1665)
                 3'-AGGACCUUCGGUAACUCGGUCCACAUC-5'      (SEQ ID NO: 2070)

AR-3171 Target:  5'-TCCTGGAAGCCATTGAGCCAGGTGTAG-3'      (SEQ ID NO: 2475)

5'-UGGAAGCCAUUGAGCCAGGUGUAgt-3'        (SEQ ID NO: 1666)
                 3'-GGACCUUCGGUAACUCGGUCCACAUCA-5'      (SEQ ID NO: 2071)

AR-3172 Target:  5'-CCTGGAAGCCATTGAGCCAGGTGTAGT-3'      (SEQ ID NO: 2476)

5'-CAGCCCGACUCCUUUGCAGCCUUgc-3'        (SEQ ID NO: 1667)
                 3'-UGGUCGGGCUGAGGAAACGUCGGAACG-5'      (SEQ ID NO: 2072)

AR-3219 Target:  5'-ACCAGCCCGACTCCTTTGCAGCCTTGC-3'      (SEQ ID NO: 2477)

5'-GACUCCUUUGCAGCCUUGCUCUCta-3'        (SEQ ID NO: 1668)
                 3'-GGCUGAGGAAACGUCGGAACGAGAGAU-5'      (SEQ ID NO: 2073)

AR-3225 Target:  5'-CCGACTCCTTTGCAGCCTTGCTCTCTA-3'      (SEQ ID NO: 2478)

5'-CAGCCUUGCUCUCUAGCCUCAAUga-3'        (SEQ ID NO: 1669)
                 3'-ACGUCGGAACGAGAGAUCGGAGUUACU-5'      (SEQ ID NO: 2074)

AR-3235 Target:  5'-TGCAGCCTTGCTCTCTAGCCTCAATGA-3'      (SEQ ID NO: 2479)

5'-GUGGUCAAGUGGGCCAAGGCCUUgc-3'        (SEQ ID NO: 1670)
                 3'-UGCACCAGUUCACCCGGUUCCGGAACG-5'      (SEQ ID NO: 2075)

AR-3285 Target:  5'-ACGTGGTCAAGTGGGCCAAGGCCTTGC-3'      (SEQ ID NO: 2480)

5'-UGGUCAAGUGGGCCAAGGCCUUGcc-3'        (SEQ ID NO: 1671)
                 3'-GCACCAGUUCACCCGGUUCCGGAACGG-5'      (SEQ ID NO: 2076)

AR-3286 Target:  5'-CGTGGTCAAGTGGGCCAAGGCCTTGCC-3'      (SEQ ID NO: 2481)

5'-GGUCAAGUGGGCCAAGGCCUUGCct-3'        (SEQ ID NO: 1672)
                 3'-CACCAGUUCACCCGGUUCCGGAACGGA-5'      (SEQ ID NO: 2077)

AR-3287 Target:  5'-GTGGTCAAGTGGGCCAAGGCCTTGCCT-3'      (SEQ ID NO: 2482)

5'-GUCAAGUGGGCCAAGGCCUUGCCtg-3'        (SEQ ID NO: 1673)
                 3'-ACCAGUUCACCCGGUUCCGGAACGGAC-5'      (SEQ ID NO: 2078)
```

TABLE 9-continued

AR Tested Duplexes, Human

```
AR-3288 Target:  5'-TGGTCAAGTGGGCCAAGGCCTTGCCTG-3'    (SEQ ID NO: 2483)

5'-UCAAGUGGGCCAAGGCCUUGCCUgg-3'     (SEQ ID NO: 1674)
                 3'-CCAGUUCACCCGGUUCCGGAACGGACC-5'   (SEQ ID NO: 2079)

AR-3289 Target:  5'-GGTCAAGTGGGCCAAGGCCTTGCCTGG-3'    (SEQ ID NO: 2484)

5'-CAAGUGGGCCAAGGCCUUGCCUGgc-3'     (SEQ ID NO: 1675)
                 3'-CAGUUCACCCGGUUCCGGAACGGACCG-5'   (SEQ ID NO: 2080)

AR-3290 Target:  5'-GTCAAGTGGGCCAAGGCCTTGCCTGGC-3'    (SEQ ID NO: 2485)

5'-AAGUGGGCCAAGGCCUUGCCUGGct-3'     (SEQ ID NO: 1676)
                 3'-AGUUCACCCGGUUCCGGAACGGACCGA-5'   (SEQ ID NO: 2081)

AR-3291 Target:  5'-TCAAGTGGGCCAAGGCCTTGCCTGGCT-3'    (SEQ ID NO: 2486)

5'-AGUGGGCCAAGGCCUUGCCUGGCtt-3'     (SEQ ID NO: 1677)
                 3'-GUUCACCCGGUUCCGGAACGGACCGAA-5'   (SEQ ID NO: 2082)

AR-3292 Target:  5'-CAAGTGGGCCAAGGCCTTGCCTGGCTT-3'    (SEQ ID NO: 2487)

5'-GUGGGCCAAGGCCUUGCCUGGCUtc-3'     (SEQ ID NO: 1678)
                 3'-UUCACCCGGUUCCGGAACGGACCGAAG-5'   (SEQ ID NO: 2083)

AR-3293 Target:  5'-AAGTGGGCCAAGGCCTTGCCTGGCTTC-3'    (SEQ ID NO: 2488)

5'-UGGGCCAAGGCCUUGCCUGGCUUcc-3'     (SEQ ID NO: 1679)
                 3'-UCACCCGGUUCCGGAACGGACCGAAGG-5'   (SEQ ID NO: 2084)

AR-3294 Target:  5'-AGTGGGCCAAGGCCTTGCCTGGCTTCC-3'    (SEQ ID NO: 2489)

5'-GGGCCAAGGCCUUGCCUGGCUUCcg-3'     (SEQ ID NO: 1680)
                 3'-CACCCGGUUCCGGAACGGACCGAAGGC-5'   (SEQ ID NO: 2085)

AR-3295 Target:  5'-GTGGGCCAAGGCCTTGCCTGGCTTCCG-3'    (SEQ ID NO: 2490)

5'-GGCCAAGGCCUUGCCUGGCUUCCgc-3'     (SEQ ID NO: 1681)
                 3'-ACCCGGUUCCGGAACGGACCGAAGGCG-5'   (SEQ ID NO: 2086)

AR-3296 Target:  5'-TGGGCCAAGGCCTTGCCTGGCTTCCGC-3'    (SEQ ID NO: 2491)

5'-GCCAAGGCCUUGCCUGGCUUCCGca-3'     (SEQ ID NO: 1682)
                 3'-CCCGGUUCCGGAACGGACCGAAGGCGU-5'   (SEQ ID NO: 2087)

AR-3297 Target:  5'-GGGCCAAGGCCTTGCCTGGCTTCCGCA-3'    (SEQ ID NO: 2492)

5'-CCAAGGCCUUGCCUGGCUUCCGCaa-3'     (SEQ ID NO: 1683)
                 3'-CCGGUUCCGGAACGGACCGAAGGCGUU-5'   (SEQ ID NO: 2088)

AR-3298 Target:  5'-GGCCAAGGCCTTGCCTGGCTTCCGCAA-3'    (SEQ ID NO: 2493)

5'-CAAGGCCUUGCCUGGCUUCCGCAac-3'     (SEQ ID NO: 1684)
                 3'-CGGUUCCGGAACGGACCGAAGGCGUUG-5'   (SEQ ID NO: 2089)

AR-3299 Target:  5'-GCCAAGGCCTTGCCTGGCTTCCGCAAC-3'    (SEQ ID NO: 2494)

5'-AAGGCCUUGCCUGGCUUCCGCAAct-3'     (SEQ ID NO: 1685)
                 3'-GGUUCCGGAACGGACCGAAGGCGUUGA-5'   (SEQ ID NO: 2090)

AR-3300 Target:  5'-CCAAGGCCTTGCCTGGCTTCCGCAACT-3'    (SEQ ID NO: 2495)

5'-AGGCCUUGCCUGGCUUCCGCAACtt-3'     (SEQ ID NO: 1686)
                 3'-GUUCCGGAACGGACCGAAGGCGUUGAA-5'   (SEQ ID NO: 2091)

AR-3301 Target:  5'-CAAGGCCTTGCCTGGCTTCCGCAACTT-3'    (SEQ ID NO: 2496)

5'-GGCCUUGCCUGGCUUCCGCAACUta-3'     (SEQ ID NO: 1687)
                 3'-UUCCGGAACGGACCGAAGGCGUUGAAU-5'   (SEQ ID NO: 2092)

AR-3302 Target:  5'-AAGGCCTTGCCTGGCTTCCGCAACTTA-3'    (SEQ ID NO: 2497)

5'-GCCUUGCCUGGCUUCCGCAACUUac-3'     (SEQ ID NO: 1688)
                 3'-UCCGGAACGGACCGAAGGCGUUGAAUG-5'   (SEQ ID NO: 2093)
```

TABLE 9-continued

AR Tested Duplexes, Human

```
AR-3303  Target:  5'-AGGCCTTGCCTGGCTTCCGCAACTTAC-3'      (SEQ ID NO: 2498)

5'-CCUUGCCUGGCUUCCGCAACUUACa-3'        (SEQ ID NO: 1689)
                  3'-CCGGAACGGACCGAAGGCGUUGAAUGU-5'      (SEQ ID NO: 2094)

AR-3304  Target:  5'-GGCCTTGCCTGGCTTCCGCAACTTACA-3'      (SEQ ID NO: 2499)

5'-CUUGCCUGGCUUCCGCAACUUACac-3'        (SEQ ID NO: 1690)
                  3'-CGGAACGGACCGAAGGCGUUGAAUGUG-5'      (SEQ ID NO: 2095)

AR-3305  Target:  5'-GCCTTGCCTGGCTTCCGCAACTTACAC-3'      (SEQ ID NO: 2500)

5'-UUGCCUGGCUUCCGCAACUUACAcg-3'        (SEQ ID NO: 1691)
                  3'-GGAACGGACCGAAGGCGUUGAAUGUGC-5'      (SEQ ID NO: 2096)

AR-3306  Target:  5'-CCTTGCCTGGCTTCCGCAACTTACACG-3'      (SEQ ID NO: 2501)

5'-UGCCUGGCUUCCGCAACUUACACgt-3'        (SEQ ID NO: 1692)
                  3'-GAACGGACCGAAGGCGUUGAAUGUGCA-5'      (SEQ ID NO: 2097)

AR-3307  Target:  5'-CTTGCCTGGCTTCCGCAACTTACACGT-3'      (SEQ ID NO: 2502)

5'-AAUGUCAACUCCAGGAUGCUCUACt-3'        (SEQ ID NO: 1693)
                  3'-GGUUACAGUUGAGGUCCUACGAGAUGA-5'      (SEQ ID NO: 2098)

AR-3408  Target:  5'-CCAATGTCAACTCCAGGATGCTCTACT-3'      (SEQ ID NO: 2503)

5'-AUGUCAACUCCAGGAUGCUCUACtt-3'        (SEQ ID NO: 1694)
                  3'-GUUACAGUUGAGGUCCUACGAGAUGAA-5'      (SEQ ID NO: 2099)

AR-3409  Target:  5'-CAATGTCAACTCCAGGATGCTCTACTT-3'      (SEQ ID NO: 2504)

5'-UGUCAACUCCAGGAUGCUCUACUtc-3'        (SEQ ID NO: 1695)
                  3'-UUACAGUUGAGGUCCUACGAGAUGAAG-5'      (SEQ ID NO: 2100)

AR-3410  Target:  5'-AATGTCAACTCCAGGATGCTCTACTTC-3'      (SEQ ID NO: 2505)

5'-GUCAACUCCAGGAUGCUCUACUUcg-3'        (SEQ ID NO: 1696)
                  3'-UACAGUUGAGGUCCUACGAGAUGAAGC-5'      (SEQ ID NO: 2101)

AR-3411  Target:  5'-ATGTCAACTCCAGGATGCTCTACTTCG-3'      (SEQ ID NO: 2506)

5'-UCAACUCCAGGAUGCUCUACUUCgc-3'        (SEQ ID NO: 1697)
                  3'-ACAGUUGAGGUCCUACGAGAUGAAGCG-5'      (SEQ ID NO: 2102)

AR-3412  Target:  5'-TGTCAACTCCAGGATGCTCTACTTCGC-3'      (SEQ ID NO: 2507)

5'-CAACUCCAGGAUGCUCUACUUCGcc-3'        (SEQ ID NO: 1698)
                  3'-CAGUUGAGGUCCUACGAGAUGAAGCGG-5'      (SEQ ID NO: 2103)

AR-3413  Target:  5'-GTCAACTCCAGGATGCTCTACTTCGCC-3'      (SEQ ID NO: 2508)

5'-AACUCCAGGAUGCUCUACUUCGCcc-3'        (SEQ ID NO: 1699)
                  3'-AGUUGAGGUCCUACGAGAUGAAGCGGG-5'      (SEQ ID NO: 2104)

AR-3414  Target:  5'-TCAACTCCAGGATGCTCTACTTCGCCC-3'      (SEQ ID NO: 2509)

5'-UGGUUUUCAAUGAGUACCGCAUGca-3'        (SEQ ID NO: 1700)
                  3'-AGACCAAAAGUUACUCAUGGCGUACGU-5'      (SEQ ID NO: 2105)

AR-3445  Target:  5'-TCTGGTTTTCAATGAGTACCGCATGCA-3'      (SEQ ID NO: 2510)

5'-GGUUUUCAAUGAGUACCGCAUGCac-3'        (SEQ ID NO: 1701)
                  3'-GACCAAAAGUUACUCAUGGCGUACGUG-5'      (SEQ ID NO: 2106)

AR-3446  Target:  5'-CTGGTTTTCAATGAGTACCGCATGCAC-3'      (SEQ ID NO: 2511)

5'-GUUUUCAAUGAGUACCGCAUGCAca-3'        (SEQ ID NO: 1702)
                  3'-ACCAAAAGUUACUCAUGGCGUACGUGU-5'      (SEQ ID NO: 2107)

AR-3447  Target:  5'-TGGTTTTCAATGAGTACCGCATGCACA-3'      (SEQ ID NO: 2512)

5'-UUUUCAAUGAGUACCGCAUGCACaa-3'        (SEQ ID NO: 1703)
                  3'-CCAAAAGUUACUCAUGGCGUACGUGUU-5'      (SEQ ID NO: 2108)
```

TABLE 9-continued

AR Tested Duplexes, Human

```
AR-3448 Target: 5'-GGTTTTCAATGAGTACCGCATGCACAA-3'   (SEQ ID NO: 2513)

5'-UUUCAAUGAGUACCGCAUGCACAag-3'    (SEQ ID NO: 1704)
                3'-CAAAAGUUACUCAUGGCGUACGUGUUC-5'  (SEQ ID NO: 2109)

AR-3449 Target: 5'-GTTTTCAATGAGTACCGCATGCACAAG-3'  (SEQ ID NO: 2514)

5'-UUCAAUGAGUACCGCAUGCACAAgt-3'   (SEQ ID NO: 1705)
                3'-AAAAGUUACUCAUGGCGUACGUGUUCA-5' (SEQ ID NO: 2110)

AR-3450 Target: 5'-TTTTCAATGAGTACCGCATGCACAAGT-3'  (SEQ ID NO: 2515)

5'-UCAAUGAGUACCGCAUGCACAAGtc-3'   (SEQ ID NO: 1706)
                3'-AAAGUUACUCAUGGCGUACGUGUUCAG-5' (SEQ ID NO: 2111)

AR-3451 Target: 5'-TTTCAATGAGTACCGCATGCACAAGTC-3'  (SEQ ID NO: 2516)

5'-CAAUGAGUACCGCAUGCACAAGUcc-3'   (SEQ ID NO: 1707)
                3'-AAGUUACUCAUGGCGUACGUGUUCAGG-5' (SEQ ID NO: 2112)

AR-3452 Target: 5'-TTCAATGAGTACCGCATGCACAAGTCC-3'  (SEQ ID NO: 2517)

5'-AAUGAGUACCGCAUGCACAAGUCcc-3'   (SEQ ID NO: 1708)
                3'-AGUUACUCAUGGCGUACGUGUUCAGGG-5' (SEQ ID NO: 2113)

AR-3453 Target: 5'-TCAATGAGTACCGCATGCACAAGTCCC-3'  (SEQ ID NO: 2518)

5'-AUGAGUACCGCAUGCACAAGUCCcg-3'   (SEQ ID NO: 1709)
                3'-GUUACUCAUGGCGUACGUGUUCAGGGC-5' (SEQ ID NO: 2114)

AR-3454 Target: 5'-CAATGAGTACCGCATGCACAAGTCCCG-3'  (SEQ ID NO: 2519)

5'-UGAGUACCGCAUGCACAAGUCCCgg-3'   (SEQ ID NO: 1710)
                3'-UUACUCAUGGCGUACGUGUUCAGGGCC-5' (SEQ ID NO: 2115)

AR-3455 Target: 5'-AATGAGTACCGCATGCACAAGTCCCGG-3'  (SEQ ID NO: 2520)

5'-GAGUACCGCAUGCACAAGUCCCGga-3'   (SEQ ID NO: 1711)
                3'-UACUCAUGGCGUACGUGUUCAGGGCCU-5' (SEQ ID NO: 2116)

AR-3456 Target: 5'-ATGAGTACCGCATGCACAAGTCCCGGA-3'  (SEQ ID NO: 2521)

5'-AGUACCGCAUGCACAAGUCCCGGat-3'   (SEQ ID NO: 1712)
                3'-ACUCAUGGCGUACGUGUUCAGGGCCUA-5' (SEQ ID NO: 2117)

AR-3457 Target: 5'-TGAGTACCGCATGCACAAGTCCCGGAT-3'  (SEQ ID NO: 2522)

5'-UCUCAAGAGUUUGGAUGGCUCCAaa-3'   (SEQ ID NO: 1713)
                3'-AGAGAGUUCUCAAACCUACCGAGGUUU-5' (SEQ ID NO: 2118)

AR-3513 Target: 5'-TCTCTCAAGAGTTTGGATGGCTCCAAA-3'  (SEQ ID NO: 2523)

5'-CUCAAGAGUUUGGAUGGCUCCAAat-3'   (SEQ ID NO: 1714)
                3'-GAGAGUUCUCAAACCUACCGAGGUUUA-5' (SEQ ID NO: 2119)

AR-3514 Target: 5'-CTCTCAAGAGTTTGGATGGCTCCAAAT-3'  (SEQ ID NO: 2524)

5'-UCAAGAGUUUGGAUGGCUCCAAAtc-3'   (SEQ ID NO: 1715)
                3'-AGAGUUCUCAAACCUACCGAGGUUUAG-5' (SEQ ID NO: 2120)

AR-3515 Target: 5'-TCTCAAGAGTTTGGATGGCTCCAAATC-3'  (SEQ ID NO: 2525)

5'-CAAGAGUUUGGAUGGCUCCAAAUca-3'   (SEQ ID NO: 1716)
                3'-GAGUUCUCAAACCUACCGAGGUUUAGU-5' (SEQ ID NO: 2121)

AR-3516 Target: 5'-CTCAAGAGTTTGGATGGCTCCAAATCA-3'  (SEQ ID NO: 2526)

5'-AAGAGUUUGGAUGGCUCCAAAUCac-3'   (SEQ ID NO: 1717)
                3'-AGUUCUCAAACCUACCGAGGUUUAGUG-5' (SEQ ID NO: 2122)

AR-3517 Target: 5'-TCAAGAGTTTGGATGGCTCCAAATCAC-3'  (SEQ ID NO: 2527)

5'-AGAGUUUGGAUGGCUCCAAAUCAcc-3'   (SEQ ID NO: 1718)
                3'-GUUCUCAAACCUACCGAGGUUUAGUGG-5' (SEQ ID NO: 2123)
```

TABLE 9-continued

AR Tested Duplexes, Human

```
AR-3518  Target:  5'-CAAGAGTTTGGATGGCTCCAAATCACC-3'   (SEQ ID NO: 2528)

5'-GAGUUUGGAUGGCUCCAAAUCACcc-3'     (SEQ ID NO: 1719)
                  3'-UUCUCAAACCUACCGAGGUUUAGUGGG-5'   (SEQ ID NO: 2124)

AR-3519  Target:  5'-AAGAGTTTGGATGGCTCCAAATCACCC-3'   (SEQ ID NO: 2529)

5'-CAGGAAUUCCUGUGCAUGAAAGCac-3'     (SEQ ID NO: 1720)
                  3'-GGGUCCUUAAGGACACGUACUUUCGUG-5'   (SEQ ID NO: 2125)

AR-3546  Target:  5'-CCCAGGAATTCCTGTGCATGAAAGCAC-3'   (SEQ ID NO: 2530)

5'-AGGAAUUCCUGUGCAUGAAAGCAct-3'    (SEQ ID NO: 1721)
                  3'-GGUCCUUAAGGACACGUACUUUCGUGA-5'   (SEQ ID NO: 2126)

AR-3547  Target:  5'-CCAGGAATTCCTGTGCATGAAAGCACT-3'   (SEQ ID NO: 2531)

5'-GGAAUUCCUGUGCAUGAAAGCACtg-3'    (SEQ ID NO: 1722)
                  3'-GUCCUUAAGGACACGUACUUUCGUGAC-5'   (SEQ ID NO: 2127)

AR-3548  Target:  5'-CAGGAATTCCTGTGCATGAAAGCACTG-3'   (SEQ ID NO: 2532)

5'-GAAUUCCUGUGCAUGAAAGCACUgc-3'    (SEQ ID NO: 1723)
                  3'-UCCUUAAGGACACGUACUUUCGUGACG-5'   (SEQ ID NO: 2128)

AR-3549  Target:  5'-AGGAATTCCTGTGCATGAAAGCACTGC-3'   (SEQ ID NO: 2533)

5'-AAUUCCUGUGCAUGAAAGCACUGct-3'    (SEQ ID NO: 1724)
                  3'-CCUUAAGGACACGUACUUUCGUGACGA-5'   (SEQ ID NO: 2129)

AR-3550  Target:  5'-GGAATTCCTGTGCATGAAAGCACTGCT-3'   (SEQ ID NO: 2534)

5'-AUUCCUGUGCAUGAAAGCACUGCta-3'    (SEQ ID NO: 1725)
                  3'-CUUAAGGACACGUACUUUCGUGACGAU-5'   (SEQ ID NO: 2130)

AR-3551  Target:  5'-GAATTCCTGTGCATGAAAGCACTGCTA-3'   (SEQ ID NO: 2535)

5'-UUCCUGUGCAUGAAAGCACUGCUac-3'    (SEQ ID NO: 1726)
                  3'-UUAAGGACACGUACUUUCGUGACGAUG-5'   (SEQ ID NO: 2131)

AR-3552  Target:  5'-AATTCCTGTGCATGAAAGCACTGCTAC-3'   (SEQ ID NO: 2536)

5'-UCCUGUGCAUGAAAGCACUGCUAct-3'    (SEQ ID NO: 1727)
                  3'-UAAGGACACGUACUUUCGUGACGAUGA-5'   (SEQ ID NO: 2132)

AR-3553  Target:  5'-ATTCCTGTGCATGAAAGCACTGCTACT-3'   (SEQ ID NO: 2537)

5'-CCUGUGCAUGAAAGCACUGCUACtc-3'    (SEQ ID NO: 1728)
                  3'-AAGGACACGUACUUUCGUGACGAUGAG-5'   (SEQ ID NO: 2133)

AR-3554  Target:  5'-TTCCTGTGCATGAAAGCACTGCTACTC-3'   (SEQ ID NO: 2538)

5'-CUGUGCAUGAAAGCACUGCUACUct-3'    (SEQ ID NO: 1729)
                  3'-AGGACACGUACUUUCGUGACGAUGAGA-5'   (SEQ ID NO: 2134)

AR-3555  Target:  5'-TCCTGTGCATGAAAGCACTGCTACTCT-3'   (SEQ ID NO: 2539)

5'-UGUGCAUGAAAGCACUGCUACUCtt-3'    (SEQ ID NO: 1730)
                  3'-GGACACGUACUUUCGUGACGAUGAGAA-5'   (SEQ ID NO: 2135)

AR-3556  Target:  5'-CCTGTGCATGAAAGCACTGCTACTCTT-3'   (SEQ ID NO: 2540)

5'-CUCUUCAGCAUUAUUCCAGUGGAtg-3'    (SEQ ID NO: 1731)
                  3'-AUGAGAAGUCGUAAUAAGGUCACCUAC-5'   (SEQ ID NO: 2136)

AR-3576  Target:  5'-TACTCTTCAGCATTATTCCAGTGGATG-3'   (SEQ ID NO: 2541)

5'-UCUUCAGCAUUAUUCCAGUGGAUgg-3'    (SEQ ID NO: 1732)
                  3'-UGAGAAGUCGUAAUAAGGUCACCUACC-5'   (SEQ ID NO: 2137)

AR-3577  Target:  5'-ACTCTTCAGCATTATTCCAGTGGATGG-3'   (SEQ ID NO: 2542)

5'-CUUCAGCAUUAUUCCAGUGGAUGgg-3'    (SEQ ID NO: 1733)
                  3'-GAGAAGUCGUAAUAAGGUCACCUACCC-5'   (SEQ ID NO: 2138)
```

TABLE 9-continued

AR Tested Duplexes, Human

```
AR-3578 Target:  5'-CTCTTCAGCATTATTCCAGTGGATGGG-3'     (SEQ ID NO: 2543)

5'-UUCAGCAUUAUUCCAGUGGAUGGgc-3'       (SEQ ID NO: 1734)
                 3'-AGAAGUCGUAAUAAGGUCACCUACCCG-5'     (SEQ ID NO: 2139)

AR-3579 Target:  5'-TCTTCAGCATTATTCCAGTGGATGGGC-3'     (SEQ ID NO: 2544)

5'-UCAGCAUUAUUCCAGUGGAUGGGct-3'       (SEQ ID NO: 1735)
                 3'-GAAGUCGUAAUAAGGUCACCUACCCGA-5'     (SEQ ID NO: 2140)

AR-3580 Target:  5'-CTTCAGCATTATTCCAGTGGATGGGCT-3'     (SEQ ID NO: 2545)

5'-CAGCAUUAUUCCAGUGGAUGGGCtg-3'       (SEQ ID NO: 1736)
                 3'-AAGUCGUAAUAAGGUCACCUACCCGAC-5'     (SEQ ID NO: 2141)

AR-3581 Target:  5'-TTCAGCATTATTCCAGTGGATGGGCTG-3'     (SEQ ID NO: 2546)

5'-AGCAUUAUUCCAGUGGAUGGGCUga-3'       (SEQ ID NO: 1737)
                 3'-AGUCGUAAUAAGGUCACCUACCCGACU-5'     (SEQ ID NO: 2142)

AR-3582 Target:  5'-TCAGCATTATTCCAGTGGATGGGCTGA-3'     (SEQ ID NO: 2547)

5'-GCAUUAUUCCAGUGGAUGGGCUGaa-3'       (SEQ ID NO: 1738)
                 3'-GUCGUAAUAAGGUCACCUACCCGACUU-5'     (SEQ ID NO: 2143)

AR-3583 Target:  5'-CAGCATTATTCCAGTGGATGGGCTGAA-3'     (SEQ ID NO: 2548)

5'-CAUUAUUCCAGUGGAUGGGCUGAaa-3'       (SEQ ID NO: 1739)
                 3'-UCGUAAUAAGGUCACCUACCCGACUUU-5'     (SEQ ID NO: 2144)

AR-3584 Target:  5'-AGCATTATTCCAGTGGATGGGCTGAAA-3'     (SEQ ID NO: 2549)

5'-AUUAUUCCAGUGGAUGGGCUGAAaa-3'       (SEQ ID NO: 1740)
                 3'-CGUAAUAAGGUCACCUACCCGACUUUU-5'     (SEQ ID NO: 2145)

AR-3585 Target:  5'-GCATTATTCCAGTGGATGGGCTGAAAA-3'     (SEQ ID NO: 2550)

5'-UUAUUCCAGUGGAUGGGCUGAAAaa-3'       (SEQ ID NO: 1741)
                 3'-GUAAUAAGGUCACCUACCCGACUUUUU-5'     (SEQ ID NO: 2146)

AR-3586 Target:  5'-CATTATTCCAGTGGATGGGCTGAAAAA-3'     (SEQ ID NO: 2551)

5'-UAUUCCAGUGGAUGGGCUGAAAAat-3'       (SEQ ID NO: 1742)
                 3'-UAAUAAGGUCACCUACCCGACUUUUUA-5'     (SEQ ID NO: 2147)

AR-3587 Target:  5'-ATTATTCCAGTGGATGGGCTGAAAAAT-3'     (SEQ ID NO: 2552)

5'-AUUCCAGUGGAUGGGCUGAAAAAtc-3'       (SEQ ID NO: 1743)
                 3'-AAUAAGGUCACCUACCCGACUUUUUAG-5'     (SEQ ID NO: 2148)

AR-3588 Target:  5'-TTATTCCAGTGGATGGGCTGAAAAATC-3'     (SEQ ID NO: 2553)

5'-UUCCAGUGGAUGGGCUGAAAAAUca-3'       (SEQ ID NO: 1744)
                 3'-AUAAGGUCACCUACCCGACUUUUUAGU-5'     (SEQ ID NO: 2149)

AR-3589 Target:  5'-TATTCCAGTGGATGGGCTGAAAAATCA-3'     (SEQ ID NO: 2554)

5'-UCCAGUGGAUGGGCUGAAAAAUCaa-3'       (SEQ ID NO: 1745)
                 3'-UAAGGUCACCUACCCGACUUUUUAGUU-5'     (SEQ ID NO: 2150)

AR-3590 Target:  5'-ATTCCAGTGGATGGGCTGAAAAATCAA-3'     (SEQ ID NO: 2555)

5'-CCAGUGGAUGGGCUGAAAAAUCAaa-3'       (SEQ ID NO: 1746)
                 3'-AAGGUCACCUACCCGACUUUUUAGUUU-5'     (SEQ ID NO: 2151)

AR-3591 Target:  5'-TTCCAGTGGATGGGCTGAAAAATCAAA-3'     (SEQ ID NO: 2556)

5'-CAGUGGAUGGGCUGAAAAAUCAAaa-3'       (SEQ ID NO: 1747)
                 3'-AGGUCACCUACCCGACUUUUUAGUUUU-5'     (SEQ ID NO: 2152)

AR-3592 Target:  5'-TCCAGTGGATGGGCTGAAAAATCAAAA-3'     (SEQ ID NO: 2557)

5'-AGUGGAUGGGCUGAAAAAUCAAAaa-3'       (SEQ ID NO: 1748)
                 3'-GGUCACCUACCCGACUUUUUAGUUUUU-5'     (SEQ ID NO: 2153)
```

TABLE 9-continued

AR Tested Duplexes, Human

```
AR-3593 Target:  5'-CCAGTGGATGGGCTGAAAAATCAAAAA-3'        (SEQ ID NO: 2558)

5'-GUGGAUGGGCUGAAAAAUCAAAAat-3'         (SEQ ID NO: 1749)
                 3'-GUCACCUACCCGACUUUUUAGUUUUUA-5'       (SEQ ID NO: 2154)

AR-3594 Target:  5'-CAGTGGATGGGCTGAAAAATCAAAAAT-3'       (SEQ ID NO: 2559)

5'-UGGAUGGGCUGAAAAAUCAAAAAtt-3'         (SEQ ID NO: 1750)
                 3'-UCACCUACCCGACUUUUUAGUUUUUAA-5'       (SEQ ID NO: 2155)

AR-3595 Target:  5'-AGTGGATGGGCTGAAAAATCAAAAATT-3'       (SEQ ID NO: 2560)

5'-GGAUGGGCUGAAAAAUCAAAAAUtc-3'         (SEQ ID NO: 1751)
                 3'-CACCUACCCGACUUUUUAGUUUUUAAG-5'       (SEQ ID NO: 2156)

AR-3596 Target:  5'-GTGGATGGGCTGAAAAATCAAAAATTC-3'       (SEQ ID NO: 2561)

5'-GAUGGGCUGAAAAAUCAAAAAUUct-3'         (SEQ ID NO: 1752)
                 3'-ACCUACCCGACUUUUUAGUUUUUAAGA-5'       (SEQ ID NO: 2157)

AR-3597 Target:  5'-TGGATGGGCTGAAAAATCAAAAATTCT-3'       (SEQ ID NO: 2562)

5'-AUGGGCUGAAAAAUCAAAAAUUCtt-3'         (SEQ ID NO: 1753)
                 3'-CCUACCCGACUUUUUAGUUUUUAAGAA-5'       (SEQ ID NO: 2158)

AR-3598 Target:  5'-GGATGGGCTGAAAAATCAAAAATTCTT-3'       (SEQ ID NO: 2563)

5'-UGGGCUGAAAAAUCAAAAAUUCUtt-3'         (SEQ ID NO: 1754)
                 3'-CUACCCGACUUUUUAGUUUUUAAGAAA-5'       (SEQ ID NO: 2159)

AR-3599 Target:  5'-GATGGGCTGAAAAATCAAAAATTCTTT-3'       (SEQ ID NO: 2564)

5'-GGGCUGAAAAAUCAAAAAUUCUUtg-3'         (SEQ ID NO: 1755)
                 3'-UACCCGACUUUUUAGUUUUUAAGAAAC-5'       (SEQ ID NO: 2160)

AR-3600 Target:  5'-ATGGGCTGAAAAATCAAAAATTCTTTG-3'       (SEQ ID NO: 2565)

5'-GGCUGAAAAAUCAAAAAUUCUUUga-3'         (SEQ ID NO: 1756)
                 3'-ACCCGACUUUUUAGUUUUUAAGAAACU-5'       (SEQ ID NO: 2161)

AR-3601 Target:  5'-TGGGCTGAAAAATCAAAAATTCTTTGA-3'       (SEQ ID NO: 2566)

5'-GCUGAAAAAUCAAAAAUUCUUUGat-3'         (SEQ ID NO: 1757)
                 3'-CCCGACUUUUUAGUUUUUAAGAAACUA-5'       (SEQ ID NO: 2162)

AR-3602 Target:  5'-GGGCTGAAAAATCAAAAATTCTTTGAT-3'       (SEQ ID NO: 2567)

5'-CUGAAAAAUCAAAAAUUCUUUGAtg-3'         (SEQ ID NO: 1758)
                 3'-CCGACUUUUUAGUUUUUAAGAAACUAC-5'       (SEQ ID NO: 2163)

AR-3603 Target:  5'-GGCTGAAAAATCAAAAATTCTTTGATG-3'       (SEQ ID NO: 2568)

5'-UGAAAAAUCAAAAAUUCUUUGAUga-3'         (SEQ ID NO: 1759)
                 3'-CGACUUUUUAGUUUUUAAGAAACUACU-5'       (SEQ ID NO: 2164)

AR-3604 Target:  5'-GCTGAAAAATCAAAAATTCTTTGATGA-3'       (SEQ ID NO: 2569)

5'-GAAAAAUCAAAAAUUCUUUGAUGaa-3'         (SEQ ID NO: 1760)
                 3'-GACUUUUUAGUUUUUAAGAAACUACUU-5'       (SEQ ID NO: 2165)

AR-3605 Target:  5'-CTGAAAAATCAAAAATTCTTTGATGAA-3'       (SEQ ID NO: 2570)

5'-AAAAAUCAAAAAUUCUUUGAUGAac-3'         (SEQ ID NO: 1761)
                 3'-ACUUUUUAGUUUUUAAGAAACUACUUG-5'       (SEQ ID NO: 2166)

AR-3606 Target:  5'-TGAAAAATCAAAAATTCTTTGATGAAC-3'       (SEQ ID NO: 2571)

5'-AAAUCAAAAAUUCUUUGAUGAACtt-3'         (SEQ ID NO: 1762)
                 3'-UUUUUAGUUUUUAAGAAACUACUUGAA-5'       (SEQ ID NO: 2167)

AR-3608 Target:  5'-AAAAATCAAAAATTCTTTGATGAACTT-3'       (SEQ ID NO: 2572)

5'-AAUCAAAAAUUCUUUGAUGAACUtc-3'         (SEQ ID NO: 1763)
                 3'-UUUUAGUUUUUAAGAAACUACUUGAAG-5'       (SEQ ID NO: 2168)
```

TABLE 9-continued

AR Tested Duplexes, Human

```
AR-3609 Target:   5'-AAAATCAAAAATTCTTTGATGAACTTC-3'   (SEQ ID NO: 2573)

5'-AUCAAAAAUUCUUUGAUGAACUUcg-3'    (SEQ ID NO: 1764)
                  3'-UUUAGUUUUUAAGAAACUACUUGAAGC-5'  (SEQ ID NO: 2169)

AR-3610 Target:   5'-AAATCAAAAATTCTTTGATGAACTTCG-3'   (SEQ ID NO: 2574)

5'-UCAAAAAUUCUUUGAUGAACUUCga-3'    (SEQ ID NO: 1765)
                  3'-UUAGUUUUUAAGAAACUACUUGAAGCU-5'  (SEQ ID NO: 2170)

AR-3611 Target:   5'-AATCAAAAATTCTTTGATGAACTTCGA-3'   (SEQ ID NO: 2575)

5'-CAAAAAUUCUUUGAUGAACUUCGaa-3'    (SEQ ID NO: 1766)
                  3'-UAGUUUUUAAGAAACUACUUGAAGCUU-5'  (SEQ ID NO: 2171)

AR-3612 Target:   5'-ATCAAAAATTCTTTGATGAACTTCGAA-3'   (SEQ ID NO: 2576)

5'-AAAAAUUCUUUGAUGAACUUCGaat-3'    (SEQ ID NO: 1767)
                  3'-AGUUUUUAAGAAACUACUUGAAGCUUA-5'  (SEQ ID NO: 2172)

AR-3613 Target:   5'-TCAAAAATTCTTTGATGAACTTCGAAT-3'   (SEQ ID NO: 2577)

5'-AAAAUUCUUUGAUGAACUUCGAAtg-3'    (SEQ ID NO: 1768)
                  3'-GUUUUUAAGAAACUACUUGAAGCUUAC-5'  (SEQ ID NO: 2173)

AR-3614 Target:   5'-CAAAAATTCTTTGATGAACTTCGAATG-3'   (SEQ ID NO: 2578)

5'-AAAUUCUUUGAUGAACUUCGAAUga-3'    (SEQ ID NO: 1769)
                  3'-UUUUUAAGAAACUACUUGAAGCUUACU-5'  (SEQ ID NO: 2174)

AR-3615 Target:   5'-AAAAATTCTTTGATGAACTTCGAATGA-3'   (SEQ ID NO: 2579)

5'-AAUUCUUUGAUGAACUUCGAAUGaa-3'    (SEQ ID NO: 1770)
                  3'-UUUUAAGAAACUACUUGAAGCUUACUU-5'  (SEQ ID NO: 2175)

AR-3616 Target:   5'-AAAATTCTTTGATGAACTTCGAATGAA-3'   (SEQ ID NO: 2580)

5'-AUUCUUUGAUGAACUUCGAAUGAac-3'    (SEQ ID NO: 1771)
                  3'-UUUAAGAAACUACUUGAAGCUUACUUG-5'  (SEQ ID NO: 2176)

AR-3617 Target:   5'-AAATTCTTTGATGAACTTCGAATGAAC-3'   (SEQ ID NO: 2581)

5'-UUCUUUGAUGAACUUCGAAUGAAct-3'    (SEQ ID NO: 1772)
                  3'-UUAAGAAACUACUUGAAGCUUACUUGA-5'  (SEQ ID NO: 2177)

AR-3618 Target:   5'-AATTCTTTGATGAACTTCGAATGAACT-3'   (SEQ ID NO: 2582)

5'-UCUUUGAUGAACUUCGAAUGAACta-3'    (SEQ ID NO: 1773)
                  3'-UAAGAAACUACUUGAAGCUUACUUGAU-5'  (SEQ ID NO: 2178)

AR-3619 Target:   5'-ATTCTTTGATGAACTTCGAATGAACTA-3'   (SEQ ID NO: 2583)

5'-CUUUGAUGAACUUCGAAUGAACUac-3'    (SEQ ID NO: 1774)
                  3'-AAGAAACUACUUGAAGCUUACUUGAUG-5'  (SEQ ID NO: 2179)

AR-3620 Target:   5'-TTCTTTGATGAACTTCGAATGAACTAC-3'   (SEQ ID NO: 2584)

5'-UUUGAUGAACUUCGAAUGAACUAca-3'    (SEQ ID NO: 1775)
                  3'-AGAAACUACUUGAAGCUUACUUGAUGU-5'  (SEQ ID NO: 2180)

AR-3621 Target:   5'-TCTTTGATGAACTTCGAATGAACTACA-3'   (SEQ ID NO: 2585)

5'-UUGAUGAACUUCGAAUGAACUACat-3'    (SEQ ID NO: 1776)
                  3'-GAAACUACUUGAAGCUUACUUGAUGUA-5'  (SEQ ID NO: 2181)

AR-3622 Target:   5'-CTTTGATGAACTTCGAATGAACTACAT-3'   (SEQ ID NO: 2586)

5'-UGAUGAACUUCGAAUGAACUACAtc-3'    (SEQ ID NO: 1777)
                  3'-AAACUACUUGAAGCUUACUUGAUGUAG-5'  (SEQ ID NO: 2182)

AR-3623 Target:   5'-TTTGATGAACTTCGAATGAACTACATC-3'   (SEQ ID NO: 2587)

5'-GAUGAACUUCGAAUGAACUACAUca-3'    (SEQ ID NO: 1778)
                  3'-AACUACUUGAAGCUUACUUGAUGUAGU-5'  (SEQ ID NO: 2183)
```

TABLE 9-continued

AR Tested Duplexes, Human

| AR-3624 Target: | 5'-TTGATGAACTTCGAATGAACTACATCA-3' | (SEQ ID NO: 2588) |
| --- | --- | --- |
| | 5'-AUGAACUUCGAAUGAACUACAUCaa-3' | (SEQ ID NO: 1779) |
| | 3'-<u>ACU</u>ACUUGAAGCUUACUUGAUGUAGUU-5' | (SEQ ID NO: 2184) |
| AR-3625 Target: | 5'-TGATGAACTTCGAATGAACTACATCAA-3' | (SEQ ID NO: 2589) |
| | 5'-UGAACUUCGAAUGAACUACAUCAag-3' | (SEQ ID NO: 1780) |
| | 3'-<u>CUA</u>CUUGAAGCUUACUUGAUGUAGUUC-5' | (SEQ ID NO: 2185) |
| AR-3626 Target: | 5'-GATGAACTTCGAATGAACTACATCAAG-3' | (SEQ ID NO: 2590) |
| | 5'-GAACUUCGAAUGAACUACAUCAAgg-3' | (SEQ ID NO: 1781) |
| | 3'-<u>UAC</u>UUGAAGCUUACUUGAUGUAGUUCC-5' | (SEQ ID NO: 2186) |
| AR-3627 Target: | 5'-ATGAACTTCGAATGAACTACATCAAGG-3' | (SEQ ID NO: 2591) |
| | 5'-AACUUCGAAUGAACUACAUCAAGga-3' | (SEQ ID NO: 1782) |
| | 3'-<u>ACU</u>UGAAGCUUACUUGAUGUAGUUCCU-5' | (SEQ ID NO: 2187) |
| AR-3628 Target: | 5'-TGAACTTCGAATGAACTACATCAAGGA-3' | (SEQ ID NO: 2592) |
| | 5'-ACUUCGAAUGAACUACAUCAAGGaa-3' | (SEQ ID NO: 1783) |
| | 3'-<u>CUU</u>GAAGCUUACUUGAUGUAGUUCCUU-5' | (SEQ ID NO: 2188) |
| AR-3629 Target: | 5'-GAACTTCGAATGAACTACATCAAGGAA-3' | (SEQ ID NO: 2593) |
| | 5'-CUUCGAAUGAACUACAUCAAGGAac-3' | (SEQ ID NO: 1784) |
| | 3'-<u>UUG</u>AAGCUUACUUGAUGUAGUUCCUUG-5' | (SEQ ID NO: 2189) |
| AR-3630 Target: | 5'-AACTTCGAATGAACTACATCAAGGAAC-3' | (SEQ ID NO: 2594) |
| | 5'-UUCGAAUGAACUACAUCAAGGAAct-3' | (SEQ ID NO: 1785) |
| | 3'-<u>UGA</u>AGCUUACUUGAUGUAGUUCCUUGA-5' | (SEQ ID NO: 2190) |
| AR-3631 Target: | 5'-ACTTCGAATGAACTACATCAAGGAACT-3' | (SEQ ID NO: 2595) |
| | 5'-UCGAAUGAACUACAUCAAGGAACtc-3' | (SEQ ID NO: 1786) |
| | 3'-<u>GAA</u>GCUUACUUGAUGUAGUUCCUUGAG-5' | (SEQ ID NO: 2191) |
| AR-3632 Target: | 5'-CTTCGAATGAACTACATCAAGGAACTC-3' | (SEQ ID NO: 2596) |
| | 5'-CGAAUGAACUACAUCAAGGAACUcg-3' | (SEQ ID NO: 1787) |
| | 3'-<u>AAG</u>CUUACUUGAUGUAGUUCCUUGAGC-5' | (SEQ ID NO: 2192) |
| AR-3633 Target: | 5'-TTCGAATGAACTACATCAAGGAACTCG-3' | (SEQ ID NO: 2597) |
| | 5'-GAAUGAACUACAUCAAGGAACUCga-3' | (SEQ ID NO: 1788) |
| | 3'-<u>AGC</u>UUACUUGAUGUAGUUCCUUGAGCU-5' | (SEQ ID NO: 2193) |
| AR-3634 Target: | 5'-TCGAATGAACTACATCAAGGAACTCGA-3' | (SEQ ID NO: 2598) |
| | 5'-AAUGAACUACAUCAAGGAACUCGat-3' | (SEQ ID NO: 1789) |
| | 3'-<u>GCU</u>UACUUGAUGUAGUUCCUUGAGCUA-5' | (SEQ ID NO: 2194) |
| AR-3635 Target: | 5'-CGAATGAACTACATCAAGGAACTCGAT-3' | (SEQ ID NO: 2599) |
| | 5'-AUGAACUACAUCAAGGAACUCGAtc-3' | (SEQ ID NO: 1790) |
| | 3'-<u>CUU</u>ACUUGAUGUAGUUCCUUGAGCUAG-5' | (SEQ ID NO: 2195) |
| AR-3636 Target: | 5'-GAATGAACTACATCAAGGAACTCGATC-3' | (SEQ ID NO: 2600) |
| | 5'-UGAACUACAUCAAGGAACUCGAUcg-3' | (SEQ ID NO: 1791) |
| | 3'-<u>UUA</u>CUUGAUGUAGUUCCUUGAGCUAGC-5' | (SEQ ID NO: 2196) |
| AR-3637 Target: | 5'-AATGAACTACATCAAGGAACTCGATCG-3' | (SEQ ID NO: 2601) |
| | 5'-GAACUACAUCAAGGAACUCGAUCgt-3' | (SEQ ID NO: 1792) |
| | 3'-<u>UAC</u>UUGAUGUAGUUCCUUGAGCUAGCA-5' | (SEQ ID NO: 2197) |
| AR-3638 Target: | 5'-ATGAACTACATCAAGGAACTCGATCGT-3' | (SEQ ID NO: 2602) |
| | 5'-AACUACAUCAAGGAACUCGAUCGta-3' | (SEQ ID NO: 1793) |
| | 3'-<u>ACU</u>UGAUGUAGUUCCUUGAGCUAGCAU-5' | (SEQ ID NO: 2198) |

TABLE 9-continued

AR Tested Duplexes, Human

```
AR-3639  Target:  5'-TGAACTACATCAAGGAACTCGATCGTA-3'    (SEQ ID NO: 2603)

5'-ACUACAUCAAGGAACUCGAUCGUat-3'      (SEQ ID NO: 1794)
                  3'-CUUGAUGUAGUUCCUUGAGCUAGCAUA-5'    (SEQ ID NO: 2199)

AR-3640  Target:  5'-GAACTACATCAAGGAACTCGATCGTAT-3'    (SEQ ID NO: 2604)

5'-CUACAUCAAGGAACUCGAUCGUAtc-3'     (SEQ ID NO: 1795)
                  3'-UUGAUGUAGUUCCUUGAGCUAGCAUAG-5'    (SEQ ID NO: 2200)

AR-3641  Target:  5'-AACTACATCAAGGAACTCGATCGTATC-3'    (SEQ ID NO: 2605)

5'-UACAUCAAGGAACUCGAUCGUAUca-3'     (SEQ ID NO: 1796)
                  3'-UGAUGUAGUUCCUUGAGCUAGCAUAGU-5'    (SEQ ID NO: 2201)

AR-3642  Target:  5'-ACTACATCAAGGAACTCGATCGTATCA-3'    (SEQ ID NO: 2606)

5'-ACAUCAAGGAACUCGAUCGUAUCat-3'     (SEQ ID NO: 1797)
                  3'-GAUGUAGUUCCUUGAGCUAGCAUAGUA-5'    (SEQ ID NO: 2202)

AR-3643  Target:  5'-CTACATCAAGGAACTCGATCGTATCAT-3'    (SEQ ID NO: 2607)

5'-AUCAUUGCAUGCAAAAGAAAAAAtc-3'     (SEQ ID NO: 1798)
                  3'-CAUAGUAACGUACGUUUUCUUUUUUAG-5'    (SEQ ID NO: 2203)

AR-3663  Target:  5'-GTATCATTGCATGCAAAAGAAAAAATC-3'    (SEQ ID NO: 2608)

5'-UCAUUGCAUGCAAAAGAAAAAAUcc-3'     (SEQ ID NO: 1799)
                  3'-AUAGUAACGUACGUUUUCUUUUUUAGG-5'    (SEQ ID NO: 2204)

AR-3664  Target:  5'-TATCATTGCATGCAAAAGAAAAAATCC-3'    (SEQ ID NO: 2609)

5'-AAUCCCACAUCCUGCUCAAGACGct-3'     (SEQ ID NO: 1800)
                  3'-UUUUAGGGUGUAGGACGAGUUCUGCGA-5'    (SEQ ID NO: 2205)

AR-3684  Target:  5'-AAAATCCCACATCCTGCTCAAGACGCT-3'    (SEQ ID NO: 2610)

5'-AUCCCACAUCCUGCUCAAGACGCtt-3'     (SEQ ID NO: 1801)
                  3'-UUUAGGGUGUAGGACGAGUUCUGCGAA-5'    (SEQ ID NO: 2206)

AR-3685  Target:  5'-AAATCCCACATCCTGCTCAAGACGCTT-3'    (SEQ ID NO: 2611)

5'-CGCUUCUACCAGCUCACCAAGCUcc-3'     (SEQ ID NO: 1802)
                  3'-CUGCGAAGAUGGUCGAGUGGUUCGAGG-5'    (SEQ ID NO: 2207)

AR-3705  Target:  5'-GACGCTTCTACCAGCTCACCAAGCTCC-3'    (SEQ ID NO: 2612)

5'-GCUUCUACCAGCUCACCAAGCUCct-3'     (SEQ ID NO: 1803)
                  3'-UGCGAAGAUGGUCGAGUGGUUCGAGGA-5'    (SEQ ID NO: 2208)

AR-3706  Target:  5'-ACGCTTCTACCAGCTCACCAAGCTCCT-3'    (SEQ ID NO: 2613)

5'-CUUCUACCAGCUCACCAAGCUCCtg-3'     (SEQ ID NO: 1804)
                  3'-GCGAAGAUGGUCGAGUGGUUCGAGGAC-5'    (SEQ ID NO: 2209)

AR-3707  Target:  5'-CGCTTCTACCAGCTCACCAAGCTCCTG-3'    (SEQ ID NO: 2614)

5'-UUCUACCAGCUCACCAAGCUCCUgg-3'     (SEQ ID NO: 1805)
                  3'-CGAAGAUGGUCGAGUGGUUCGAGGACC-5'    (SEQ ID NO: 2210)

AR-3708  Target:  5'-GCTTCTACCAGCTCACCAAGCTCCTGG-3'    (SEQ ID NO: 2615)

5'-UCUACCAGCUCACCAAGCUCCUGga-3'     (SEQ ID NO: 1806)
                  3'-GAAGAUGGUCGAGUGGUUCGAGGACCU-5'    (SEQ ID NO: 2211)

AR-3709  Target:  5'-CTTCTACCAGCTCACCAAGCTCCTGGA-3'    (SEQ ID NO: 2616)

5'-CUACCAGCUCACCAAGCUCCUGGac-3'     (SEQ ID NO: 1807)
                  3'-AAGAUGGUCGAGUGGUUCGAGGACCUG-5'    (SEQ ID NO: 2212)

AR-3710  Target:  5'-TTCTACCAGCTCACCAAGCTCCTGGAC-3'    (SEQ ID NO: 2617)

5'-UACCAGCUCACCAAGCUCCUGGAct-3'     (SEQ ID NO: 1808)
                  3'-AGAUGGUCGAGUGGUUCGAGGACCUGA-5'    (SEQ ID NO: 2213)
```

TABLE 9-continued

AR Tested Duplexes, Human

```
AR-3711 Target:  5'-TCTACCAGCTCACCAAGCTCCTGGACT-3'   (SEQ ID NO: 2618)

5'-ACCAGCUCACCAAGCUCCUGGACtc-3'     (SEQ ID NO: 1809)
                 3'-GAUGGUCGAGUGGUUCGAGGACCUGAG-5'   (SEQ ID NO: 2214)

AR-3712 Target:  5'-CTACCAGCTCACCAAGCTCCTGGACTC-3'   (SEQ ID NO: 2619)

5'-CCAGCUCACCAAGCUCCUGGACUcc-3'    (SEQ ID NO: 1810)
                 3'-AUGGUCGAGUGGUUCGAGGACCUGAGG-5'  (SEQ ID NO: 2215)

AR-3713 Target:  5'-TACCAGCTCACCAAGCTCCTGGACTCC-3'   (SEQ ID NO: 2620)

5'-CAGCUCACCAAGCUCCUGGACUCcg-3'    (SEQ ID NO: 1811)
                 3'-UGGUCGAGUGGUUCGAGGACCUGAGGC-5'  (SEQ ID NO: 2216)

AR-3714 Target:  5'-ACCAGCTCACCAAGCTCCTGGACTCCG-3'   (SEQ ID NO: 2621)

5'-AGCUCACCAAGCUCCUGGACUCCgt-3'    (SEQ ID NO: 1812)
                 3'-GGUCGAGUGGUUCGAGGACCUGAGGCA-5'  (SEQ ID NO: 2217)

AR-3715 Target:  5'-CCAGCTCACCAAGCTCCTGGACTCCGT-3'   (SEQ ID NO: 2622)

5'-CUCACCAAGCUCCUGGACUCCGUgc-3'    (SEQ ID NO: 1813)
                 3'-UCGAGUGGUUCGAGGACCUGAGGCACG-5'  (SEQ ID NO: 2218)

AR-3717 Target:  5'-AGCTCACCAAGCTCCTGGACTCCGTGC-3'   (SEQ ID NO: 2623)

5'-CUCCUGGACUCCGUGCAGCCUAUtg-3'    (SEQ ID NO: 1814)
                 3'-UCGAGGACCUGAGGCACGUCGGAUAAC-5'  (SEQ ID NO: 2219)

AR-3726 Target:  5'-AGCTCCTGGACTCCGTGCAGCCTATTG-3'   (SEQ ID NO: 2624)

5'-CGUGCAGCCUAUUGCGAGAGAGCtg-3'    (SEQ ID NO: 1815)
                 3'-AGGCACGUCGGAUAACGCUCUCUCGAC-5'  (SEQ ID NO: 2220)

AR-3737 Target:  5'-TCCGTGCAGCCTATTGCGAGAGAGCTG-3'   (SEQ ID NO: 2625)

5'-AGAGAGCUGCAUCAGUUCACUUUtg-3'    (SEQ ID NO: 1816)
                 3'-GCUCUCUCGACGUAGUCAAGUGAAAAC-5'  (SEQ ID NO: 2221)

AR-3753 Target:  5'-CGAGAGAGCTGCATCAGTTCACTTTTG-3'   (SEQ ID NO: 2626)

5'-GAGAGCUGCAUCAGUUCACUUUUga-3'    (SEQ ID NO: 1817)
                 3'-CUCUCUCGACGUAGUCAAGUGAAAACU-5'  (SEQ ID NO: 2222)

AR-3754 Target:  5'-GAGAGAGCTGCATCAGTTCACTTTTGA-3'   (SEQ ID NO: 2627)

5'-AGAGCUGCAUCAGUUCACUUUUGac-3'    (SEQ ID NO: 1818)
                 3'-UCUCUCGACGUAGUCAAGUGAAAACUG-5'  (SEQ ID NO: 2223)

AR-3755 Target:  5'-AGAGAGCTGCATCAGTTCACTTTTGAC-3'   (SEQ ID NO: 2628)

5'-GAGCUGCAUCAGUUCACUUUUGAcc-3'    (SEQ ID NO: 1819)
                 3'-CUCUCGACGUAGUCAAGUGAAAACUGG-5'  (SEQ ID NO: 2224)

AR-3756 Target:  5'-GAGAGCTGCATCAGTTCACTTTTGACC-3'   (SEQ ID NO: 2629)

5'-AGCUGCAUCAGUUCACUUUUGACct-3'    (SEQ ID NO: 1820)
                 3'-UCUCGACGUAGUCAAGUGAAAACUGGA-5'  (SEQ ID NO: 2225)

AR-3757 Target:  5'-AGAGCTGCATCAGTTCACTTTTGACCT-3'   (SEQ ID NO: 2630)

5'-GCUGCAUCAGUUCACUUUUGACCtg-3'    (SEQ ID NO: 1821)
                 3'-CUCGACGUAGUCAAGUGAAAACUGGAC-5'  (SEQ ID NO: 2226)

AR-3758 Target:  5'-GAGCTGCATCAGTTCACTTTTGACCTG-3'   (SEQ ID NO: 2631)

5'-CUGCAUCAGUUCACUUUUGACCUgc-3'    (SEQ ID NO: 1822)
                 3'-UCGACGUAGUCAAGUGAAAACUGGACG-5'  (SEQ ID NO: 2227)

AR-3759 Target:  5'-AGCTGCATCAGTTCACTTTTGACCTGC-3'   (SEQ ID NO: 2632)

5'-UGCAUCAGUUCACUUUUGACCUGct-3'    (SEQ ID NO: 1823)
                 3'-CGACGUAGUCAAGUGAAAACUGGACGA-5'  (SEQ ID NO: 2228)
```

TABLE 9-continued

AR Tested Duplexes, Human

```
AR-3760 Target:  5'-GCTGCATCAGTTCACTTTTGACCTGCT-3'     (SEQ ID NO: 2633)

5'-GCAUCAGUUCACUUUUGACCUGCta-3'      (SEQ ID NO: 1824)
                 3'-GACGUAGUCAAGUGAAAACUGGACGAU-5'    (SEQ ID NO: 2229)

AR-3761 Target:  5'-CTGCATCAGTTCACTTTTGACCTGCTA-3'    (SEQ ID NO: 2634)

5'-CAUCAGUUCACUUUUGACCUGCUaa-3'     (SEQ ID NO: 1825)
                 3'-ACGUAGUCAAGUGAAAACUGGACGAUU-5'    (SEQ ID NO: 2230)

AR-3762 Target:  5'-TGCATCAGTTCACTTTTGACCTGCTAA-3'    (SEQ ID NO: 2635)

5'-AUCAGUUCACUUUUGACCUGCUAat-3'     (SEQ ID NO: 1826)
                 3'-CGUAGUCAAGUGAAAACUGGACGAUUA-5'    (SEQ ID NO: 2231)

AR-3763 Target:  5'-GCATCAGTTCACTTTTGACCTGCTAAT-3'    (SEQ ID NO: 2636)

5'-UCAGUUCACUUUUGACCUGCUAAtc-3'     (SEQ ID NO: 1827)
                 3'-GUAGUCAAGUGAAAACUGGACGAUUAG-5'    (SEQ ID NO: 2232)

AR-3764 Target:  5'-CATCAGTTCACTTTTGACCTGCTAATC-3'    (SEQ ID NO: 2637)

5'-CAGUUCACUUUUGACCUGCUAAUca-3'     (SEQ ID NO: 1828)
                 3'-UAGUCAAGUGAAAACUGGACGAUUAGU-5'    (SEQ ID NO: 2233)

AR-3765 Target:  5'-ATCAGTTCACTTTTGACCTGCTAATCA-3'    (SEQ ID NO: 2638)

5'-AGUUCACUUUUGACCUGCUAAUCaa-3'     (SEQ ID NO: 1829)
                 3'-AGUCAAGUGAAAACUGGACGAUUAGUU-5'    (SEQ ID NO: 2234)

AR-3766 Target:  5'-TCAGTTCACTTTTGACCTGCTAATCAA-3'    (SEQ ID NO: 2639)

5'-GUUCACUUUUGACCUGCUAAUCAag-3'     (SEQ ID NO: 1830)
                 3'-GUCAAGUGAAAACUGGACGAUUAGUUC-5'    (SEQ ID NO: 2235)

AR-3767 Target:  5'-CAGTTCACTTTTGACCTGCTAATCAAG-3'    (SEQ ID NO: 2640)

5'-UUCACUUUUGACCUGCUAAUCAAgt-3'     (SEQ ID NO: 1831)
                 3'-UCAAGUGAAAACUGGACGAUUAGUUCA-5'    (SEQ ID NO: 2236)

AR-3768 Target:  5'-AGTTCACTTTTGACCTGCTAATCAAGT-3'    (SEQ ID NO: 2641)

5'-UCACUUUUGACCUGCUAAUCAAGtc-3'     (SEQ ID NO: 1832)
                 3'-CAAGUGAAAACUGGACGAUUAGUUCAG-5'    (SEQ ID NO: 2237)

AR-3769 Target:  5'-GTTCACTTTTGACCTGCTAATCAAGTC-3'    (SEQ ID NO: 2642)

5'-CACUUUUGACCUGCUAAUCAAGUca-3'     (SEQ ID NO: 1833)
                 3'-AAGUGAAAACUGGACGAUUAGUUCAGU-5'    (SEQ ID NO: 2238)

AR-3770 Target:  5'-TTCACTTTTGACCTGCTAATCAAGTCA-3'    (SEQ ID NO: 2643)

5'-ACUUUUGACCUGCUAAUCAAGUCac-3'     (SEQ ID NO: 1834)
                 3'-AGUGAAAACUGGACGAUUAGUUCAGUG-5'    (SEQ ID NO: 2239)

AR-3771 Target:  5'-TCACTTTTGACCTGCTAATCAAGTCAC-3'    (SEQ ID NO: 2644)

5'-CUUUUGACCUGCUAAUCAAGUCAca-3'     (SEQ ID NO: 1835)
                 3'-GUGAAAACUGGACGAUUAGUUCAGUGU-5'    (SEQ ID NO: 2240)

AR-3772 Target:  5'-CACTTTTGACCTGCTAATCAAGTCACA-3'    (SEQ ID NO: 2645)

5'-UUUUGACCUGCUAAUCAAGUCACac-3'     (SEQ ID NO: 1836)
                 3'-UGAAAACUGGACGAUUAGUUCAGUGUG-5'    (SEQ ID NO: 2241)

AR-3773 Target:  5'-ACTTTTGACCTGCTAATCAAGTCACAC-3'    (SEQ ID NO: 2646)

5'-AUGGUGAGCGUGGACUUUCCGGAaa-3'     (SEQ ID NO: 1837)
                 3'-UGUACCACUCGCACCUGAAAGGCCUUU-5'    (SEQ ID NO: 2242)

AR-3798 Target:  5'-ACATGGTGAGCGTGGACTTTCCGGAAA-3'    (SEQ ID NO: 2647)

5'-UGGUGAGCGUGGACUUUCCGGAAat-3'     (SEQ ID NO: 1838)
                 3'-GUACCACUCGCACCUGAAAGGCCUUUA-5'    (SEQ ID NO: 2243)
```

TABLE 9-continued

AR Tested Duplexes, Human

```
AR-3799 Target:  5'-CATGGTGAGCGTGGACTTTCCGGAAAT-3'   (SEQ ID NO: 2648)

5'-GAAAUGAUGGCAGAGAUCAUCUCtg-3'    (SEQ ID NO: 1839)
                 3'-GCCUUUACUACCGUCUCUAGUAGAGAC-5'  (SEQ ID NO: 2244)

AR-3819 Target:  5'-CGGAAATGATGGCAGAGATCATCTCTG-3'   (SEQ ID NO: 2649)

5'-AAAUGAUGGCAGAGAUCAUCUCUgt-3'    (SEQ ID NO: 1840)
                 3'-CCUUUACUACCGUCUCUAGUAGAGACA-5'  (SEQ ID NO: 2245)

AR-3820 Target:  5'-GGAAATGATGGCAGAGATCATCTCTGT-3'   (SEQ ID NO: 2650)

5'-AAUGAUGGCAGAGAUCAUCUCUGtg-3'    (SEQ ID NO: 1841)
                 3'-CUUUACUACCGUCUCUAGUAGAGACAC-5'  (SEQ ID NO: 2246)

AR-3821 Target:  5'-GAAATGATGGCAGAGATCATCTCTGTG-3'   (SEQ ID NO: 2651)

5'-AUGAUGGCAGAGAUCAUCUCUGUgc-3'    (SEQ ID NO: 1842)
                 3'-UUUACUACCGUCUCUAGUAGAGACACG-5'  (SEQ ID NO: 2247)

AR-3822 Target:  5'-AAATGATGGCAGAGATCATCTCTGTGC-3'   (SEQ ID NO: 2652)

5'-UGAUGGCAGAGAUCAUCUCUGUGca-3'    (SEQ ID NO: 1843)
                 3'-UUACUACCGUCUCUAGUAGAGACACGU-5'  (SEQ ID NO: 2248)

AR-3823 Target:  5'-AATGATGGCAGAGATCATCTCTGTGCA-3'   (SEQ ID NO: 2653)

5'-GAUGGCAGAGAUCAUCUCUGUGCaa-3'    (SEQ ID NO: 1844)
                 3'-UACUACCGUCUCUAGUAGAGACACGUU-5'  (SEQ ID NO: 2249)

AR-3824 Target:  5'-ATGATGGCAGAGATCATCTCTGTGCAA-3'   (SEQ ID NO: 2654)

5'-AUGGCAGAGAUCAUCUCUGUGCAag-3'    (SEQ ID NO: 1845)
                 3'-ACUACCGUCUCUAGUAGAGACACGUUC-5'  (SEQ ID NO: 2250)

AR-3825 Target:  5'-TGATGGCAGAGATCATCTCTGTGCAAG-3'   (SEQ ID NO: 2655)

5'-UGGCAGAGAUCAUCUCUGUGCAAgt-3'    (SEQ ID NO: 1846)
                 3'-CUACCGUCUCUAGUAGAGACACGUUCA-5'  (SEQ ID NO: 2251)

AR-3826 Target:  5'-GATGGCAGAGATCATCTCTGTGCAAGT-3'   (SEQ ID NO: 2656)

5'-GGCAGAGAUCAUCUCUGUGCAAGtg-3'    (SEQ ID NO: 1847)
                 3'-UACCGUCUCUAGUAGAGACACGUUCAC-5'  (SEQ ID NO: 2252)

AR-3827 Target:  5'-ATGGCAGAGATCATCTCTGTGCAAGTG-3'   (SEQ ID NO: 2657)

5'-GCAGAGAUCAUCUCUGUGCAAGUgc-3'    (SEQ ID NO: 1848)
                 3'-ACCGUCUCUAGUAGAGACACGUUCACG-5'  (SEQ ID NO: 2253)

AR-3828 Target:  5'-TGGCAGAGATCATCTCTGTGCAAGTGC-3'   (SEQ ID NO: 2658)

5'-CAGAGAUCAUCUCUGUGCAAGUGcc-3'    (SEQ ID NO: 1849)
                 3'-CCGUCUCUAGUAGAGACACGUUCACGG-5'  (SEQ ID NO: 2254)

AR-3829 Target:  5'-GGCAGAGATCATCTCTGTGCAAGTGCC-3'   (SEQ ID NO: 2659)

5'-AGAGAUCAUCUCUGUGCAAGUGCcc-3'    (SEQ ID NO: 1850)
                 3'-CGUCUCUAGUAGAGACACGUUCACGGG-5'  (SEQ ID NO: 2255)

AR-3830 Target:  5'-GCAGAGATCATCTCTGTGCAAGTGCCC-3'   (SEQ ID NO: 2660)

5'-GAGAUCAUCUCUGUGCAAGUGCCca-3'    (SEQ ID NO: 1851)
                 3'-GUCUCUAGUAGAGACACGUUCACGGGU-5'  (SEQ ID NO: 2256)

AR-3831 Target:  5'-CAGAGATCATCTCTGTGCAAGTGCCCA-3'   (SEQ ID NO: 2661)

5'-AGAUCAUCUCUGUGCAAGUGCCCaa-3'    (SEQ ID NO: 1852)
                 3'-UCUCUAGUAGAGACACGUUCACGGGUU-5'  (SEQ ID NO: 2257)

AR-3832 Target:  5'-AGAGATCATCTCTGTGCAAGTGCCCAA-3'   (SEQ ID NO: 2662)

5'-GAUCAUCUCUGUGCAAGUGCCCAag-3'    (SEQ ID NO: 1853)
                 3'-CUCUAGUAGAGACACGUUCACGGGUUC-5'  (SEQ ID NO: 2258)
```

TABLE 9-continued

AR Tested Duplexes, Human

```
AR-3833 Target:  5'-GAGATCATCTCTGTGCAAGTGCCCAAG-3'    (SEQ ID NO: 2663)

5'-AUCAUCUCUGUGCAAGUGCCCAAga-3'      (SEQ ID NO: 1854)
                 3'-UCUAGUAGAGACACGUUCACGGGUUCU-5'    (SEQ ID NO: 2259)

AR-3834 Target:  5'-AGATCATCTCTGTGCAAGTGCCCAAGA-3'    (SEQ ID NO: 2664)

5'-UCAUCUCUGUGCAAGUGCCCAAGat-3'      (SEQ ID NO: 1855)
                 3'-CUAGUAGAGACACGUUCACGGGUUCUA-5'    (SEQ ID NO: 2260)

AR-3835 Target:  5'-GATCATCTCTGTGCAAGTGCCCAAGAT-3'    (SEQ ID NO: 2665)

5'-CAUCUCUGUGCAAGUGCCCAAGAtc-3'      (SEQ ID NO: 1856)
                 3'-UAGUAGAGACACGUUCACGGGUUCUAG-5'    (SEQ ID NO: 2261)

AR-3836 Target:  5'-ATCATCTCTGTGCAAGTGCCCAAGATC-3'    (SEQ ID NO: 2666)

5'-AUCUCUGUGCAAGUGCCCAAGAUcc-3'      (SEQ ID NO: 1857)
                 3'-AGUAGAGACACGUUCACGGGUUCUAGG-5'    (SEQ ID NO: 2262)

AR-3837 Target:  5'-TCATCTCTGTGCAAGTGCCCAAGATCC-3'    (SEQ ID NO: 2667)

5'-UCUCUGUGCAAGUGCCCAAGAUCct-3'      (SEQ ID NO: 1858)
                 3'-GUAGAGACACGUUCACGGGUUCUAGGA-5'    (SEQ ID NO: 2263)

AR-3838 Target:  5'-CATCTCTGTGCAAGTGCCCAAGATCCT-3'    (SEQ ID NO: 2668)

5'-CUCUGUGCAAGUGCCCAAGAUCCtt-3'      (SEQ ID NO: 1859)
                 3'-UAGAGACACGUUCACGGGUUCUAGGAA-5'    (SEQ ID NO: 2264)

AR-3839 Target:  5'-ATCTCTGTGCAAGTGCCCAAGATCCTT-3'    (SEQ ID NO: 2669)

5'-UCUGUGCAAGUGCCCAAGAUCCUtt-3'      (SEQ ID NO: 1860)
                 3'-AGAGACACGUUCACGGGUUCUAGGAAA-5'    (SEQ ID NO: 2265)

AR-3840 Target:  5'-TCTCTGTGCAAGTGCCCAAGATCCTTT-3'    (SEQ ID NO: 2670)

5'-CUGUGCAAGUGCCCAAGAUCCUUtc-3'      (SEQ ID NO: 1861)
                 3'-GAGACACGUUCACGGGUUCUAGGAAAG-5'    (SEQ ID NO: 2266)

AR-3841 Target:  5'-CTCTGTGCAAGTGCCCAAGATCCTTTC-3'    (SEQ ID NO: 2671)

5'-UGUGCAAGUGCCCAAGAUCCUUUct-3'      (SEQ ID NO: 1862)
                 3'-AGACACGUUCACGGGUUCUAGGAAAGA-5'    (SEQ ID NO: 2267)

AR-3842 Target:  5'-TCTGTGCAAGTGCCCAAGATCCTTTCT-3'    (SEQ ID NO: 2672)

5'-GUGCAAGUGCCCAAGAUCCUUUCtg-3'      (SEQ ID NO: 1863)
                 3'-GACACGUUCACGGGUUCUAGGAAAGAC-5'    (SEQ ID NO: 2268)

AR-3843 Target:  5'-CTGTGCAAGTGCCCAAGATCCTTTCTG-3'    (SEQ ID NO: 2673)

5'-UGCAAGUGCCCAAGAUCCUUUCUgg-3'      (SEQ ID NO: 1864)
                 3'-ACACGUUCACGGGUUCUAGGAAAGACC-5'    (SEQ ID NO: 2269)

AR-3844 Target:  5'-TGTGCAAGTGCCCAAGATCCTTTCTGG-3'    (SEQ ID NO: 2674)

5'-GCAAGUGCCCAAGAUCCUUUCUGgg-3'      (SEQ ID NO: 1865)
                 3'-CACGUUCACGGGUUCUAGGAAAGACCC-5'    (SEQ ID NO: 2270)

AR-3845 Target:  5'-GTGCAAGTGCCCAAGATCCTTTCTGGG-3'    (SEQ ID NO: 2675)

5'-CAAGUGCCCAAGAUCCUUUCUGGga-3'      (SEQ ID NO: 1866)
                 3'-ACGUUCACGGGUUCUAGGAAAGACCCU-5'    (SEQ ID NO: 2271)

AR-3846 Target:  5'-TGCAAGTGCCCAAGATCCTTTCTGGGA-3'    (SEQ ID NO: 2676)

5'-AAGUGCCCAAGAUCCUUUCUGGGaa-3'      (SEQ ID NO: 1867)
                 3'-CGUUCACGGGUUCUAGGAAAGACCCUU-5'    (SEQ ID NO: 2272)

AR-3847 Target:  5'-GCAAGTGCCCAAGATCCTTTCTGGGAA-3'    (SEQ ID NO: 2677)

5'-AGUGCCCAAGAUCCUUUCUGGGAaa-3'      (SEQ ID NO: 1868)
                 3'-GUUCACGGGUUCUAGGAAAGACCCUUU-5'    (SEQ ID NO: 2273)
```

TABLE 9-continued

AR Tested Duplexes, Human

| | | |
|---|---|---|
| AR-3848 Target: | 5'-CAAGTGCCCAAGATCCTTTCTGGGAAA-3' | (SEQ ID NO: 2678) |
| | 5'-GUGCCCAAGAUCCUUUCUGGGAAag-3' | (SEQ ID NO: 1869) |
| | 3'-UUCACGGGUUCUAGGAAAGACCCUUUC-5' | (SEQ ID NO: 2274) |
| AR-3849 Target: | 5'-AAGTGCCCAAGATCCTTTCTGGGAAAG-3' | (SEQ ID NO: 2679) |
| | 5'-UGCCCAAGAUCCUUUCUGGGAAAgt-3' | (SEQ ID NO: 1870) |
| | 3'-UCACGGGUUCUAGGAAAGACCCUUUCA-5' | (SEQ ID NO: 2275) |
| AR-3850 Target: | 5'-AGTGCCCAAGATCCTTTCTGGGAAAGT-3' | (SEQ ID NO: 2680) |
| | 5'-GCCCAAGAUCCUUUCUGGGAAAGtc-3' | (SEQ ID NO: 1871) |
| | 3'-CACGGGUUCUAGGAAAGACCCUUUCAG-5' | (SEQ ID NO: 2276) |
| AR-3851 Target: | 5'-GTGCCCAAGATCCTTTCTGGGAAAGTC-3' | (SEQ ID NO: 2681) |
| | 5'-CCCAAGAUCCUUUCUGGGAAAGUca-3' | (SEQ ID NO: 1872) |
| | 3'-ACGGGUUCUAGGAAAGACCCUUUCAGU-5' | (SEQ ID NO: 2277) |
| AR-3852 Target: | 5'-TGCCCAAGATCCTTTCTGGGAAAGTCA-3' | (SEQ ID NO: 2682) |
| | 5'-CCAAGAUCCUUUCUGGGAAAGUCaa-3' | (SEQ ID NO: 1873) |
| | 3'-CGGGUUCUAGGAAAGACCCUUUCAGUU-5' | (SEQ ID NO: 2278) |
| AR-3853 Target: | 5'-GCCCAAGATCCTTTCTGGGAAAGTCAA-3' | (SEQ ID NO: 2683) |
| | 5'-CAAGAUCCUUUCUGGGAAAGUCAag-3' | (SEQ ID NO: 1874) |
| | 3'-GGGUUCUAGGAAAGACCCUUUCAGUUC-5' | (SEQ ID NO: 2279) |
| AR-3854 Target: | 5'-CCCAAGATCCTTTCTGGGAAAGTCAAG-3' | (SEQ ID NO: 2684) |
| | 5'-AAGAUCCUUUCUGGGAAAGUCAAgc-3' | (SEQ ID NO: 1875) |
| | 3'-GGUUCUAGGAAAGACCCUUUCAGUUCG-5' | (SEQ ID NO: 2280) |
| AR-3855 Target: | 5'-CCAAGATCCTTTCTGGGAAAGTCAAGC-3' | (SEQ ID NO: 2685) |
| | 5'-AGAUCCUUUCUGGGAAAGUCAAGcc-3' | (SEQ ID NO: 1876) |
| | 3'-GUUCUAGGAAAGACCCUUUCAGUUCGG-5' | (SEQ ID NO: 2281) |
| AR-3856 Target: | 5'-CAAGATCCTTTCTGGGAAAGTCAAGCC-3' | (SEQ ID NO: 2686) |
| | 5'-GAUCCUUUCUGGGAAAGUCAAGCcc-3' | (SEQ ID NO: 1877) |
| | 3'-UUCUAGGAAAGACCCUUUCAGUUCGGG-5' | (SEQ ID NO: 2282) |
| AR-3857 Target: | 5'-AAGATCCTTTCTGGGAAAGTCAAGCCC-3' | (SEQ ID NO: 2687) |
| | 5'-AUCCUUUCUGGGAAAGUCAAGCCca-3' | (SEQ ID NO: 1878) |
| | 3'-UCUAGGAAAGACCCUUUCAGUUCGGGU-5' | (SEQ ID NO: 2283) |
| AR-3858 Target: | 5'-AGATCCTTTCTGGGAAAGTCAAGCCCA-3' | (SEQ ID NO: 2688) |
| | 5'-UCCUUUCUGGGAAAGUCAAGCCCat-3' | (SEQ ID NO: 1879) |
| | 3'-CUAGGAAAGACCCUUUCAGUUCGGGUA-5' | (SEQ ID NO: 2284) |
| AR-3859 Target: | 5'-GATCCTTTCTGGGAAAGTCAAGCCCAT-3' | (SEQ ID NO: 2689) |
| | 5'-CCUUUCUGGGAAAGUCAAGCCCAtc-3' | (SEQ ID NO: 1880) |
| | 3'-UAGGAAAGACCCUUUCAGUUCGGGUAG-5' | (SEQ ID NO: 2285) |
| AR-3860 Target: | 5'-ATCCTTTCTGGGAAAGTCAAGCCCATC-3' | (SEQ ID NO: 2690) |
| | 5'-CUUUCUGGGAAAGUCAAGCCCAUct-3' | (SEQ ID NO: 1881) |
| | 3'-AGGAAAGACCCUUUCAGUUCGGGUAGA-5' | (SEQ ID NO: 2286) |
| AR-3861 Target: | 5'-TCCTTTCTGGGAAAGTCAAGCCCATCT-3' | (SEQ ID NO: 2691) |
| | 5'-UUUCUGGGAAAGUCAAGCCCAUCta-3' | (SEQ ID NO: 1882) |
| | 3'-GGAAAGACCCUUUCAGUUCGGGUAGAU-5' | (SEQ ID NO: 2287) |
| AR-3862 Target: | 5'-CCTTTCTGGGAAAGTCAAGCCCATCTA-3' | (SEQ ID NO: 2692) |
| | 5'-UUCUGGGAAAGUCAAGCCCAUCUat-3' | (SEQ ID NO: 1883) |
| | 3'-GAAAGACCCUUUCAGUUCGGGUAGAUA-5' | (SEQ ID NO: 2288) |

TABLE 9-continued

AR Tested Duplexes, Human

```
AR-3863 Target:  5'-CTTTCTGGGAAAGTCAAGCCCATCTAT-3'    (SEQ ID NO: 2693)

5'-UCUGGGAAAGUCAAGCCCAUCUAtt-3'     (SEQ ID NO: 1884)
                 3'-AAAGACCCUUUCAGUUCGGGUAGAUAA-5'   (SEQ ID NO: 2289)

AR-3864 Target:  5'-TTTCTGGGAAAGTCAAGCCCATCTATT-3'    (SEQ ID NO: 2694)

5'-CUGGGAAAGUCAAGCCCAUCUAUtt-3'     (SEQ ID NO: 1885)
                 3'-AAGACCCUUUCAGUUCGGGUAGAUAAA-5'   (SEQ ID NO: 2290)

AR-3865 Target:  5'-TTCTGGGAAAGTCAAGCCCATCTATTT-3'    (SEQ ID NO: 2695)

5'-UGGGAAAGUCAAGCCCAUCUAUUtc-3'     (SEQ ID NO: 1886)
                 3'-AGACCCUUUCAGUUCGGGUAGAUAAAG-5'   (SEQ ID NO: 2291)

AR-3866 Target:  5'-TCTGGGAAAGTCAAGCCCATCTATTTC-3'    (SEQ ID NO: 2696)

5'-GGGAAAGUCAAGCCCAUCUAUUUcc-3'     (SEQ ID NO: 1887)
                 3'-GACCCUUUCAGUUCGGGUAGAUAAAGG-5'   (SEQ ID NO: 2292)

AR-3867 Target:  5'-CTGGGAAAGTCAAGCCCATCTATTTCC-3'    (SEQ ID NO: 2697)

5'-GGAAAGUCAAGCCCAUCUAUUUCca-3'     (SEQ ID NO: 1888)
                 3'-ACCCUUUCAGUUCGGGUAGAUAAAGGU-5'   (SEQ ID NO: 2293)

AR-3868 Target:  5'-TGGGAAAGTCAAGCCCATCTATTTCCA-3'    (SEQ ID NO: 2698)

5'-GAAAGUCAAGCCCAUCUAUUUCCac-3'     (SEQ ID NO: 1889)
                 3'-CCCUUUCAGUUCGGGUAGAUAAAGGUG-5'   (SEQ ID NO: 2294)

AR-3869 Target:  5'-GGGAAAGTCAAGCCCATCTATTTCCAC-3'    (SEQ ID NO: 2699)

5'-AAAGUCAAGCCCAUCUAUUUCCAca-3'     (SEQ ID NO: 1890)
                 3'-CCUUUCAGUUCGGGUAGAUAAAGGUGU-5'   (SEQ ID NO: 2295)

AR-3870 Target:  5'-GGAAAGTCAAGCCCATCTATTTCCACA-3'    (SEQ ID NO: 2700)

5'-AAGUCAAGCCCAUCUAUUUCCACac-3'     (SEQ ID NO: 1891)
                 3'-CUUUCAGUUCGGGUAGAUAAAGGUGUG-5'   (SEQ ID NO: 2296)

AR-3871 Target:  5'-GAAAGTCAAGCCCATCTATTTCCACAC-3'    (SEQ ID NO: 2701)

5'-CAGAUGUCUUCUGCCUGUUAUAAct-3'     (SEQ ID NO: 1892)
                 3'-AAGUCUACAGAAGACGGACAAUAUUGA-5'   (SEQ ID NO: 2297)

AR-3947 Target:  5'-TTCAGATGTCTTCTGCCTGTTATAACT-3'    (SEQ ID NO: 2702)

5'-AGAUGUCUUCUGCCUGUUAUAACtc-3'     (SEQ ID NO: 1893)
                 3'-AGUCUACAGAAGACGGACAAUAUUGAG-5'   (SEQ ID NO: 2298)

AR-3948 Target:  5'-TCAGATGTCTTCTGCCTGTTATAACTC-3'    (SEQ ID NO: 2703)

5'-GAUGUCUUCUGCCUGUUAUAACUct-3'     (SEQ ID NO: 1894)
                 3'-GUCUACAGAAGACGGACAAUAUUGAGA-5'   (SEQ ID NO: 2299)

AR-3949 Target:  5'-CAGATGTCTTCTGCCTGTTATAACTCT-3'    (SEQ ID NO: 2704)

5'-AUGUCUUCUGCCUGUUAUAACUCtg-3'     (SEQ ID NO: 1895)
                 3'-UCUACAGAAGACGGACAAUAUUGAGAC-5'   (SEQ ID NO: 2300)

AR-3950 Target:  5'-AGATGTCTTCTGCCTGTTATAACTCTG-3'    (SEQ ID NO: 2705)

5'-GGAAUUUCCUCUAUUGAUGUACAgt-3'     (SEQ ID NO: 1896)
                 3'-CCCCUUAAAGGAGAUAACUACAUGUCA-5'   (SEQ ID NO: 2301)

AR-3999 Target:  5'-GGGGAATTTCCTCTATTGATGTACAGT-3'    (SEQ ID NO: 2706)

5'-GCUGGGCUUUUUUUUCUCUUUUCtc-3'     (SEQ ID NO: 1897)
                 3'-AACGACCCGAAAAAAAAGAGAAAAGAG-5'   (SEQ ID NO: 2302)

AR-4054 Target:  5'-TTGCTGGGCTTTTTTTTCTCTTTCTC-3'     (SEQ ID NO: 2707)

5'-CUGGGCUUUUUUUUCUCUUUUCUct-3'     (SEQ ID NO: 1898)
                 3'-ACGACCCGAAAAAAAAGAGAAAAGAGA-5'   (SEQ ID NO: 2303)
```

TABLE 9-continued

AR Tested Duplexes, Human

```
AR-4055 Target:   5'-TGCTGGGCTTTTTTTTCTCTTTCTCT-3'     (SEQ ID NO: 2708)

5'-UUUUUUUUUCUCUUUCUCUCCUUtc-3'     (SEQ ID NO: 1899)
                  3'-CGAAAAAAAAGAGAAAGAGAGGAAAG-5'    (SEQ ID NO: 2304)

AR-4061 Target:   5'-GCTTTTTTTTCTCTTTCTCTCCTTTC-3'    (SEQ ID NO: 2709)

5'-UUUUCUCUUUCUCUCCUUUCUUUtt-3'    (SEQ ID NO: 1900)
                  3'-AAAAAAGAGAAAGAGAGGAAAGAAAAA-5'  (SEQ ID NO: 2305)

AR-4066 Target:   5'-TTTTTTCTCTTTCTCTCCTTTCTTTTT-3'  (SEQ ID NO: 2710)

5'-UUUUUCUUCUUCCCUCCCUAUCUaa-3'    (SEQ ID NO: 1901)
                  3'-AGAAAAAGAAGAAGGGAGGGAUAGAUU-5'  (SEQ ID NO: 2306)

AR-4086 Target:   5'-TCTTTTTCTTCTTCCCTCCCTATCTAA-3'  (SEQ ID NO: 2711)

5'-UUGUAUGCCUUUAAAUCUGUGAUga-3'    (SEQ ID NO: 1902)
                  3'-ACAACAUACGGAAAUUUAGACACUACU-5'  (SEQ ID NO: 2307)

AR-4174 Target:   5'-TGTTGTATGCCTTTAAATCTGTGATGA-3'  (SEQ ID NO: 2712)

5'-UGCUUGUUUACAGCACUACUCUGtg-3'    (SEQ ID NO: 1903)
                  3'-ACACGAACAAAUGUCGUGAUGAGACAC-5'  (SEQ ID NO: 2308)

AR-4225 Target:   5'-TGTGCTTGTTTACAGCACTACTCTGTG-3'  (SEQ ID NO: 2713)

5'-AGAGAGCUAAGAUUAUCUGGGGAaa-3'    (SEQ ID NO: 1904)
                  3'-AAUCUCUCGAUUCUAAUAGACCCCUUU-5'  (SEQ ID NO: 2309)

AR-4293 Target:   5'-TTAGAGAGCTAAGATTATCTGGGGAAA-3'  (SEQ ID NO: 2714)

5'-GGAAAUCAAAACAAAAACAAGCAaa-3'    (SEQ ID NO: 1905)
                  3'-CCCCUUUAGUUUUGUUUUUGUUCGUUU-5'  (SEQ ID NO: 2310)

AR-4313 Target:   5'-GGGGAAATCAAAACAAAAACAAGCAAA-3' (SEQ ID NO: 2715)
```

TABLE 10

AR Tested Duplexes, Mouse

```
                  5'-CAGCAGCACACUGAGGAUGGUUCtc-3'    (SEQ ID NO: 3526)
                  3'-CCGUCGUCGUGUGACUCCUACCAAGAG-5'  (SEQ ID NO: 3574)

AR-m258 Target:   5'-GGCAGCAGCACACTGAGGATGGTTCTC-3'  (SEQ ID NO: 3622)

5'-CCGAGGGCCACCCUGAGAGCAGCtg-3'    (SEQ ID NO: 3527)
                  3'-GAGGCUCCCGGUGGGACUCUCGUCGAC-5'  (SEQ ID NO: 3575)

AR-m361 Target:   5'-CTCCGAGGGCCACCCTGAGAGCAGCTG-3'  (SEQ ID NO: 3623)

5'-GCCACCCUGAGAGCAGCUGCCUCcc-3'    (SEQ ID NO: 3528)
                  3'-CCCGGUGGGACUCUCGUCGACGGAGGG-5'  (SEQ ID NO: 3576)

AR-m367 Target:   5'-GGGCCACCCTGAGAGCAGCTGCCTCCC-3'  (SEQ ID NO: 3624)

5'-CUGCCGCAGCAGCCACCAGCUCCtc-3'    (SEQ ID NO: 3529)
                  3'-CCGACGGCGUCGUCGGUGGUCGAGGAG-5'  (SEQ ID NO: 3577)

AR-m426 Target:   5'-GGCTGCCGCAGCAGCCACCAGCTCCTC-3'  (SEQ ID NO: 3625)

5'-CUUUCCCAGGCUUAAGCAGCUGCtc-3'    (SEQ ID NO: 3530)
                  3'-GUGAAAGGGUCCGAAUUCGUCGACGAG-5'  (SEQ ID NO: 3578)

AR-m502 Target:   5'-CACTTTCCCAGGCTTAAGCAGCTGCTC-3'  (SEQ ID NO: 3626)

5'-GCAACUUCUUCAGCAGCAGCAACaa-3'    (SEQ ID NO: 3531)
                  3'-UACGUUGAAGAAGUCGUCGUCGUUGUU-5'  (SEQ ID NO: 3579)
```

TABLE 10-continued

AR Tested Duplexes, Mouse

```
AR-m566   Target:  5'-ATGCAACTTCTTCAGCAGCAGCAACAA-3'    (SEQ ID NO: 3627)

5'-GCGUCCCACUCCUUGUGCGCCGCtg-3'      (SEQ ID NO: 3532)
                   3'-CACGCAGGGUGAGGAACACGCGGCGAC-5'    (SEQ ID NO: 3580)

AR-m872   Target:  5'-GTGCGTCCCACTCCTTGTGCGCCGCTG-3'    (SEQ ID NO: 3628)

5'-GGCAGCAGUGAAGCAGGUAGCUCtg-3'      (SEQ ID NO: 3533)
                   3'-GACCGUCGUCACUUCGUCCAUCGAGAC-5'    (SEQ ID NO: 3581)

AR-m1020  Target:  5'-CTGGCAGCAGTGAAGCAGGTAGCTCTG-3'    (SEQ ID NO: 3629)

5'-UCCGCUGGCUCUGUCCGGGCCGCcg-3'      (SEQ ID NO: 3534)
                   3'-AAAGGCGACCGAGACAGGCCCGGCGGC-5'    (SEQ ID NO: 3582)

AR-m1136  Target:  5'-TTTCCGCTGGCTCTGTCCGGGCCGCCG-3'    (SEQ ID NO: 3630)

5'-AGCGCCUGGGCUGCGGCGGCAGCgc-3'      (SEQ ID NO: 3535)
                   3'-CGUCGCGGACCCGACGCCGCCGUCGCG-5'    (SEQ ID NO: 3583)

AR-m1224  Target:  5'-GCAGCGCCTGGGCTGCGGCGGCAGCGC-3'    (SEQ ID NO: 3631)

5'-CUGGGCUGCGGCGGCAGCGCAAUgc-3'      (SEQ ID NO: 3536)
                   3'-CGGACCCGACGCCGCCGUCGCGUUACG-5'    (SEQ ID NO: 3584)

AR-m1229  Target:  5'-GCCTGGGCTGCGGCGGCAGCGCAATGC-3'    (SEQ ID NO: 3632)

5'-GCGGCGGCAGCGCAAUGCCGCUAtg-3'      (SEQ ID NO: 3537)
                   3'-GACGCCGCCGUCGCGUUACGGCGAUAC-5'    (SEQ ID NO: 3585)

AR-m1236  Target:  5'-CTGCGGCGGCAGCGCAATGCCGCTATG-3'    (SEQ ID NO: 3633)

5'-UAGCCGGGCCCAGCACUGGAUCGcc-3'      (SEQ ID NO: 3538)
                   3'-ACAUCGGCCCGGGUCGUGACCUAGCGG-5'    (SEQ ID NO: 3586)

AR-m1291  Target:  5'-TGTAGCCGGGCCCAGCACTGGATCGCC-3'    (SEQ ID NO: 3634)

5'-UCCUGGCAUACUCUCUUCACAGCtg-3'      (SEQ ID NO: 3539)
                   3'-GAAGGACCGUAUGAGAGAAGUGUCGAC-5'    (SEQ ID NO: 3587)

AR-m1335  Target:  5'-CTTCCTGGCATACTCTCTTCACAGCTG-3'    (SEQ ID NO: 3635)

5'-CAGCCCAAGCGAUGCCGGGCCUGta-3'      (SEQ ID NO: 3540)
                   3'-UCGUCGGGUUCGCUACGGCCCGGACAU-5'    (SEQ ID NO: 3588)

AR-m1403  Target:  5'-AGCAGCCCAAGCGATGCCGGGCCTGTA-3'    (SEQ ID NO: 3636)

5'-UUCUGGCUGUCACUACGGAGCUCtc-3'      (SEQ ID NO: 3541)
                   3'-CGAAGACCGACAGUGAUGCCUCGAGAG-5'    (SEQ ID NO: 3589)

AR-m1694  Target:  5'-GCTTCTGGCTGTCACTACGGAGCTCTC-3'    (SEQ ID NO: 3637)

5'-GAGCUCUCACUUGUGGCAGCUGCaa-3'      (SEQ ID NO: 3542)
                   3'-GCCUCGAGAGUGAACACCGUCGACGUU-5'    (SEQ ID NO: 3590)

AR-m1711  Target:  5'-CGGAGCTCTCACTTGTGGCAGCTGCAA-3'    (SEQ ID NO: 3638)

5'-CUUGUGGCAGCUGCAAGGUCUUCtt-3'      (SEQ ID NO: 3543)
                   3'-GUGAACACCGUCGACGUUCCAGAAGAA-5'    (SEQ ID NO: 3591)

AR-m1720  Target:  5'-CACTTGTGGCAGCTGCAAGGTCTTCTT-3'    (SEQ ID NO: 3639)

5'-GGCAGCUGCAAGGUCUUCUUCAAaa-3'      (SEQ ID NO: 3544)
                   3'-CACCGUCGACGUUCCAGAAGAAGUUUU-5'    (SEQ ID NO: 3592)

AR-m1725  Target:  5'-GTGGCAGCTGCAAGGTCTTCTTCAAAA-3'    (SEQ ID NO: 3640)

5'-GAUGACUCUGGGAGCUCGUAAGCtg-3'      (SEQ ID NO: 3545)
                   3'-CCCUACUGAGACCCUCGAGCAUUCGAC-5'    (SEQ ID NO: 3593)

AR-m1865  Target:  5'-GGGATGACTCTGGGAGCTCGTAAGCTG-3'    (SEQ ID NO: 3641)

5'-GGGAGCUCGUAAGCUGAAGAAACtt-3'      (SEQ ID NO: 3546)
                   3'-GACCCUCGAGCAUUCGACUUCUUUGAA-5'    (SEQ ID NO: 3594)
```

TABLE 10-continued

AR Tested Duplexes, Mouse

AR-m1874 Target: 5'-CTGGGAGCTCGTAAGCTGAAGAAACTT-3'  (SEQ ID NO: 3642)

5'-GAUUCCUUUGCUGCCUUGUUAUCta-3'    (SEQ ID NO: 3547)
               3'-GUCUAAGGAAACGACGGAACAAUAGAU-5'  (SEQ ID NO: 3595)

AR-m2079 Target: 5'-CAGATTCCTTTGCTGCCTTGTTATCTA-3'  (SEQ ID NO: 3643)

5'-UUGCUGCCUUGUUAUCUAGCCUCaa-3'    (SEQ ID NO: 3548)
               3'-GAAACGACGGAACAAUAGAUCGGAGUU-5'  (SEQ ID NO: 3596)

AR-m2086 Target: 5'-CTTTGCTGCCTTGTTATCTAGCCTCAA-3'  (SEQ ID NO: 3644)

5'-GCCUGGCUUCCGCAACUUGCAUGtg-3'    (SEQ ID NO: 3549)
               3'-AACGGACCGAAGGCGUUGAACGUACAC-5'  (SEQ ID NO: 3597)

AR-m2162 Target: 5'-TTGCCTGGCTTCCGCAACTTGCATGTG-3'  (SEQ ID NO: 3645)

5'-GAUGGGACUGAUGGUAUUUGCCAtg-3'    (SEQ ID NO: 3550)
               3'-ACCUACCCUGACUACCAUAAACGGUAC-5'  (SEQ ID NO: 3598)

AR-m2219 Target: 5'-TGGATGGGACTGATGGTATTTGCCATG-3'  (SEQ ID NO: 3646)

5'-GGAUGCUCUACUUUGCACCUGACtt-3'    (SEQ ID NO: 3551)
               3'-GUCCUACGAGAUGAAACGUGGACUGAA-5'  (SEQ ID NO: 3599)

AR-m2275 Target: 5'-CAGGATGCTCTACTTTGCACCTGACTT-3'  (SEQ ID NO: 3647)

5'-CUCUACUUUGCACCUGACUUGGUtt-3'    (SEQ ID NO: 3552)
               3'-ACGAGAUGAAACGUGGACUGAACCAAA-5'  (SEQ ID NO: 3600)

AR-m2280 Target: 5'-TGCTCTACTTTGCACCTGACTTGGTTT-3'  (SEQ ID NO: 3648)

5'-UUGCACCUGACUUGGUUUUCAAUga-3'    (SEQ ID NO: 3553)
               3'-GAAACGUGGACUGAACCAAAAGUUACU-5'  (SEQ ID NO: 3601)

AR-m2287 Target: 5'-CTTTGCACCTGACTTGGTTTTCAATGA-3'  (SEQ ID NO: 3649)

5'-CUUGGUUUUCAAUGAGUACCGCAtg-3'    (SEQ ID NO: 3554)
               3'-CUGAACCAAAAGUUACUCAUGGCGUAC-5'  (SEQ ID NO: 3602)

AR-m2297 Target: 5'-GACTTGGTTTTCAATGAGTACCGCATG-3'  (SEQ ID NO: 3650)

5'-GUACCGCAUGCACAAGUCUCGGAtg-3'    (SEQ ID NO: 3555)
               3'-CUCAUGGCGUACGUGUUCAGAGCCUAC-5'  (SEQ ID NO: 3603)

AR-m2312 Target: 5'-GAGTACCGCATGCACAAGTCTCGGATG-3'  (SEQ ID NO: 3651)

5'-GUGCAUGAAAGCACUGCUGCUCUtc-3'    (SEQ ID NO: 3556)
               3'-GACACGUACUUUCGUGACGACGAGAAG-5'  (SEQ ID NO: 3604)

AR-m2411 Target: 5'-CTGTGCATGAAAGCACTGCTGCTCTTC-3'  (SEQ ID NO: 3652)

5'-UGAAAGCACUGCUGCUCUUCAGCat-3'    (SEQ ID NO: 3557)
               3'-GUACUUUCGUGACGACGAGAAGUCGUA-5'  (SEQ ID NO: 3605)

AR-m2416 Target: 5'-CATGAAAGCACTGCTGCTCTTCAGCAT-3'  (SEQ ID NO: 3653)

5'-CACUGCUGCUCUUCAGCAUUAUUcc-3'    (SEQ ID NO: 3558)
               3'-UCGUGACGACGAGAAGUCGUAAUAAGG-5'  (SEQ ID NO: 3606)

AR-m2422 Target: 5'-AGCACTGCTGCTCTTCAGCATTATTCC-3'  (SEQ ID NO: 3654)

5'-CUGCUCUUCAGCAUUAUUCCAGUgg-3'    (SEQ ID NO: 3559)
               3'-ACGACGAGAAGUCGUAAUAAGGUCACC-5'  (SEQ ID NO: 3607)

AR-m2427 Target: 5'-TGCTGCTCTTCAGCATTATTCCAGTGG-3'  (SEQ ID NO: 3655)

5'-CUCACCAAGCUCCUGGAUUCUGUgc-3'    (SEQ ID NO: 3560)
               3'-UCGAGUGGUUCGAGGACCUAAGACACG-5'  (SEQ ID NO: 3608)

AR-m2571 Target: 5'-AGCTCACCAAGCTCCTGGATTCTGTGC-3'  (SEQ ID NO: 3656)

5'-CUCCUGGAUUCUGUGCAGCCUAUtg-3'    (SEQ ID NO: 3561)
               3'-UCGAGGACCUAAGACACGUCGGAUAAC-5'  (SEQ ID NO: 3609)

TABLE 10-continued

AR Tested Duplexes, Mouse

```
AR-m2580 Target: 5'-AGCTCCTGGATTCTGTGCAGCCTATTG-3'   (SEQ ID NO: 3657)

5'-GGAUUCUGUGCAGCCUAUUGCAAga-3'    (SEQ ID NO: 3562)
                  3'-GACCUAAGACACGUCGGAUAACGUUCU-5'  (SEQ ID NO: 3610)

AR-m2585 Target: 5'-CTGGATTCTGTGCAGCCTATTGCAAGA-3'   (SEQ ID NO: 3658)

5'-UGUGCAGCCUAUUGCAAGAGAGCtg-3'    (SEQ ID NO: 3563)
                  3'-AGACACGUCGGAUAACGUUCUCUCGAC-5'  (SEQ ID NO: 3611)

AR-m2591 Target: 5'-TCTGTGCAGCCTATTGCAAGAGAGCTG-3'   (SEQ ID NO: 3659)

5'-GCCUAUUGCAAGAGAGCUGCAUCag-3'    (SEQ ID NO: 3564)
                  3'-GUCGGAUAACGUUCUCUCGACGUAGUC-5'  (SEQ ID NO: 3612)

AR-m2597 Target: 5'-CAGCCTATTGCAAGAGAGCTGCATCAG-3'   (SEQ ID NO: 3660)

5'-GUGGACUUUCCUGAAAUGAUGGCag-3'    (SEQ ID NO: 3565)
                  3'-CGCACCUGAAAGGACUUUACUACCGUC-5'  (SEQ ID NO: 3613)

AR-m2661 Target: 5'-GCGTGGACTTTCCTGAAATGATGGCAG-3'   (SEQ ID NO: 3661)

5'-UUCUGCCUGUUAUAUAACUCUGCac-3'    (SEQ ID NO: 3566)
                  3'-AGAAGACGGACAAUAUAUUGAGACGUG-5'  (SEQ ID NO: 3614)

AR-m2809 Target: 5'-TCTTCTGCCTGTTATATAACTCTGCAC-3'   (SEQ ID NO: 3662)

5'-CACUACUUCUCUGCAGUGCCUUGgg-3'    (SEQ ID NO: 3567)
                  3'-ACGUGAUGAAGAGACGUCACGGAACCC-5'  (SEQ ID NO: 3615)

AR-m2831 Target: 5'-TGCACTACTTCTCTGCAGTGCCTTGGG-3'   (SEQ ID NO: 3663)

5'-CUGGGCUUCUCCUUCUUUUUUUUtc-3'    (SEQ ID NO: 3568)
                  3'-AGGACCCGAAGAGGAAGAAAAAAAAAG-5'  (SEQ ID NO: 3616)

AR-m2912 Target: 5'-TCCTGGGCTTCTCCTTCTTTTTTTTC-3'    (SEQ ID NO: 3664)

5'-UUCUCCUUCUUUUUUUUCUUCUtc-3'     (SEQ ID NO: 3569)
                  3'-CGAAGAGGAAGAAAAAAAAGAAGAAG-5'   (SEQ ID NO: 3617)

AR-m2918 Target: 5'-GCTTCTCCTTCTTTTTTTTCTTCTTC-3'    (SEQ ID NO: 3665)

5'-CUUUUUUUUCUUCUUCCCUCCCtc-3'     (SEQ ID NO: 3570)
                  3'-AAGAAAAAAAAGAAGAAGGGAGGGAG-5'   (SEQ ID NO: 3618)

AR-m2926 Target: 5'-TTCTTTTTTTTCTTCTTCCCTCCCTC-3'    (SEQ ID NO: 3666)

5'-GCUGCGUAUUGUGGCUCCUGCCUtt-3'    (SEQ ID NO: 3571)
                  3'-GACGACGCAUAACACCGAGGACGGAAA-5'  (SEQ ID NO: 3619)

AR-m2981 Target: 5'-CTGCTGCGTATTGTGGCTCCTGCCTTT-3'   (SEQ ID NO: 3667)

5'-UGGCUCCUGCCUUUGUUUUGAUUtc-3'    (SEQ ID NO: 3572)
                  3'-ACACCGAGGACGGAAACAAAACUAAAG-5'  (SEQ ID NO: 3620)

AR-m2992 Target: 5'-TGTGGCTCCTGCCTTTGTTTTGATTTC-3'   (SEQ ID NO: 3668)

5'-CCUGCCUUUGUUUUGAUUUCUGUtg-3'    (SEQ ID NO: 3573)
                  3'-GAGGACGGAAACAAAACUAAAGACAAC-5'  (SEQ ID NO: 3621)

AR-m2997 Target: 5'-CTCCTGCCTTTGTTTTGATTTCTGTTG-3'   (SEQ ID NO: 3669)
```

TABLE 11

AR Duplexes, Unmodified forms of Tested Duplexes, Human

```
                  5'-GCCAGCUUGCUGGGAGAGCGGGACG-3'    (SEQ ID NO: 2716)
                  3'-CUCGGUCGAACGACCCUCUCGCCCUGC-5'  (SEQ ID NO: 1906)

AR-39 Target:     5'-GAGCCAGCTTGCTGGGAGAGCGGGACG-3'  (SEQ ID NO: 2311)

5'-GCUCCAGCGACAGCCAACGCCUCUU-3'    (SEQ ID NO: 2717)
                  3'-GCCGAGGUCGCUGUCGGUUGCGGAGAA-5'  (SEQ ID NO: 1907)
```

TABLE 11-continued

AR Duplexes, Unmodified forms of Tested Duplexes, Human

```
AR-174 Target:   5'-CGGCTCCAGCGACAGCCAACGCCTCTT-3'   (SEQ ID NO: 2312)

5'-GCCAACGCCUCUUGCAGCGCGGCGG-3'    (SEQ ID NO: 2718)
                 3'-GUCGGUUGCGGAGAACGUCGCGCCGCC-5'  (SEQ ID NO: 1908)

AR-186 Target:   5'-CAGCCAACGCCTCTTGCAGCGCGGCGG-3'   (SEQ ID NO: 2313)

5'-CUCUUGCAGCGCGGCGGCUUCGAAG-3'    (SEQ ID NO: 2719)
                 3'-CGGAGAACGUCGCGCCGCCGAAGCUUC-5'  (SEQ ID NO: 1909)

AR-194 Target:   5'-GCCTCTTGCAGCGCGGCGGCTTCGAAG-3'   (SEQ ID NO: 2314)

5'-CAGCGCGGCGGCUUCGAAGCCGCCG-3'    (SEQ ID NO: 2720)
                 3'-ACGUCGCGCCGCCGAAGCUUCGGCGGC-5'  (SEQ ID NO: 1910)

AR-200 Target:   5'-TGCAGCGCGGCGGCTTCGAAGCCGCCG-3'   (SEQ ID NO: 2315)

5'-AAGCCGCCGCCCGGAGCUGCCCUUU-3'    (SEQ ID NO: 2721)
                 3'-GCUUCGGCGGCGGGCCUCGACGGGAAA-5'  (SEQ ID NO: 1911)

AR-216 Target:   5'-CGAAGCCGCCGCCCGGAGCTGCCCTTT-3'   (SEQ ID NO: 2316)

5'-CCGCCCGGAGCUGCCCUUUCCUCUU-3'    (SEQ ID NO: 2722)
                 3'-GCGGCGGGCCUCGACGGGAAAGGAGAA-5'  (SEQ ID NO: 1912)

AR-222 Target:   5'-CGCCGCCCGGAGCTGCCCTTTCCTCTT-3'   (SEQ ID NO: 2317)

5'-AAGUUUUUAAAAGCUGCUAAAGACU-3'    (SEQ ID NO: 2723)
                 3'-ACUUCAAAAAUUUUCGACGAUUUCUGA-5'  (SEQ ID NO: 1913)

AR-252 Target:   5'-TGAAGTTTTTAAAAGCTGCTAAAGACT-3'   (SEQ ID NO: 2318)

5'-GUCUUCUCUCCCGCAGCUGCCUCAG-3'    (SEQ ID NO: 2724)
                 3'-GGCAGAAGAGAGGGCGUCGACGGAGUC-5'  (SEQ ID NO: 1914)

AR-375 Target:   5'-CCGTCTTCTCTCCCGCAGCTGCCTCAG-3'   (SEQ ID NO: 2319)

5'-GCAGCUGCCUCAGUCGGCUACUCUC-3'    (SEQ ID NO: 2725)
                 3'-GGCGUCGACGGAGUCAGCCGAUGAGAG-5'  (SEQ ID NO: 1915)

AR-387 Target:   5'-CCGCAGCTGCCTCAGTCGGCTACTCTC-3'   (SEQ ID NO: 2320)

5'-UGGCUGCGAGCGGGCGAGCUAGCUG-3'    (SEQ ID NO: 2726)
                 3'-AAACCGACGCUCGCCCGCUCGAUCGAC-5'  (SEQ ID NO: 1916)

AR-506 Target:   5'-TTTGGCTGCGAGCGGGCGAGCTAGCTG-3'   (SEQ ID NO: 2321)

5'-GGCGAGCUAGCUGCACAUUGCAAAG-3'    (SEQ ID NO: 2727)
                 3'-GCCCGCUCGAUCGACGUGUAACGUUUC-5'  (SEQ ID NO: 1917)

AR-518 Target:   5'-CGGGCGAGCTAGCTGCACATTGCAAAG-3'   (SEQ ID NO: 2322)

5'-UCUCUCCACCUCCUCCUGCCUUCCC-3'    (SEQ ID NO: 2728)
                 3'-AGAGAGAGGUGGAGGAGGACGGAAGGG-5'  (SEQ ID NO: 1918)

AR-646 Target:   5'-TCTCTCTCCACCTCCTCCTGCCTTCCC-3'   (SEQ ID NO: 2323)

5'-AGAGAUCAAAAGAUGAAAAGGCAGU-3'    (SEQ ID NO: 2729)
                 3'-GGUCUCUAGUUUUCUACUUUUCCGUCA-5'  (SEQ ID NO: 1919)

AR-689 Target:   5'-CCAGAGATCAAAAGATGAAAAGGCAGT-3'   (SEQ ID NO: 2324)

5'-GUAGCCAAAAAACAAAACAAACAAA-3'    (SEQ ID NO: 2730)
                 3'-GUCAUCGGUUUUUUGUUUUGUUUGUUU-5'  (SEQ ID NO: 1920)

AR-724 Target:   5'-CAGTAGCCAAAAAACAAAACAAACAAA-3'   (SEQ ID NO: 2325)

5'-AAAAAACAAAACAAACAAAAACAAA-3'    (SEQ ID NO: 2731)
                 3'-GGUUUUUUGUUUUGUUUGUUUUUGUUU-5'  (SEQ ID NO: 1921)

AR-730 Target:   5'-CCAAAAAACAAAACAAACAAAAACAAA-3'   (SEQ ID NO: 2326)

5'-AAAACAAACAAAAACAAAAAAGCCG-3'    (SEQ ID NO: 2732)
                 3'-UGUUUUGUUUGUUUUUGUUUUUUCGGC-5'  (SEQ ID NO: 1922)
```

TABLE 11-continued

AR Duplexes, Unmodified forms of Tested Duplexes, Human

```
AR-737 Target:    5'-ACAAAACAAACAAAAACAAAAAAGCCG-3'    (SEQ ID NO: 2327)

5'-AAAAAAGCCGAAAUAAAAGAAAAAG-3'      (SEQ ID NO: 2733)
                  3'-UGUUUUUUCGGCUUUAUUUUCUUUUUC-5'    (SEQ ID NO: 1923)

AR-752 Target:    5'-ACAAAAAAGCCGAAATAAAAGAAAAAG-3'    (SEQ ID NO: 2328)

5'-CGAAAUAAAAGAAAAAGAUAAUAAC-3'      (SEQ ID NO: 2734)
                  3'-CGGCUUUAUUUUCUUUUUCUAUUAUUG-5'    (SEQ ID NO: 1924)

AR-760 Target:    5'-GCCGAAATAAAGAAAAAGATAATAAC-3'     (SEQ ID NO: 2329)

5'-GAAAAAGAUAAUAACUCAGUUCUUA-3'      (SEQ ID NO: 2735)
                  3'-UUCUUUUUCUAUUAUUGAGUCAAGAAU-5'    (SEQ ID NO: 1925)

AR-770 Target:    5'-AAGAAAAAGATAATAACTCAGTTCTTA-3'    (SEQ ID NO: 2330)

5'-AGAUAAUAACUCAGUUCUUAUUUGC-3'      (SEQ ID NO: 2736)
                  3'-UUUCUAUUAUUGAGUCAAGAAUAAACG-5'    (SEQ ID NO: 1926)

AR-775 Target:    5'-AAAGATAATAACTCAGTTCTTATTTGC-3'    (SEQ ID NO: 2331)

5'-UAAUAACUCAGUUCUUAUUUGCACC-3'      (SEQ ID NO: 2737)
                  3'-CUAUUAUUGAGUCAAGAAUAAACGUGG-5'    (SEQ ID NO: 1927)

AR-778 Target:    5'-GATAATAACTCAGTTCTTATTTGCACC-3'    (SEQ ID NO: 2332)

5'-GAGGAUUUUGUUUUUUCUUUUAAG-3'       (SEQ ID NO: 2738)
                  3'-ACCUCCUAAAACAAAAAAGAAAAUUC-5'     (SEQ ID NO: 1928)

AR-833 Target:    5'-TGGAGGATTTTGTTTTTTCTTTTAAG-3'     (SEQ ID NO: 2333)

5'-UUUUGUUUUUUCUUUUAAGAUCUG-3'       (SEQ ID NO: 2739)
                  3'-CUAAAACAAAAAAGAAAAUUCUAGAC-5'     (SEQ ID NO: 1929)

AR-838 Target:    5'-GATTTGTTTTTTCTTTTAAGATCTG-3'      (SEQ ID NO: 2334)

5'-UUUUUUCUUUUAAGAUCUGGGCAUC-3'      (SEQ ID NO: 2740)
                  3'-CAAAAAAGAAAAUUCUAGACCCGUAG-5'     (SEQ ID NO: 1930)

AR-844 Target:    5'-GTTTTTTCTTTTAAGATCTGGGCATC-3'     (SEQ ID NO: 2335)

5'-GCAUCUUUUGAAUCUACCCUUCAAG-3'      (SEQ ID NO: 2741)
                  3'-CCCGUAGAAAACUUAGAUGGGAAGUUC-5'    (SEQ ID NO: 1931)

AR-864 Target:    5'-GGGCATCTTTTGAATCTACCCTTCAAG-3'    (SEQ ID NO: 2336)

5'-GAGCGCUUUUUGCGUGGUUGCUCCC-3'      (SEQ ID NO: 2742)
                  3'-GUCUCGCGAAAAACGCACCAACGAGGG-5'    (SEQ ID NO: 1932)

AR-971 Target:    5'-CAGAGCGCTTTTTGCGTGGTTGCTCCC-3'    (SEQ ID NO: 2337)

5'-CUUUUUGCGUGGUUGCUCCCGCAAG-3'      (SEQ ID NO: 2743)
                  3'-GCGAAAAACGCACCAACGAGGGCGUUC-5'    (SEQ ID NO: 1933)

AR-976 Target:    5'-CGCTTTTTGCGTGGTTGCTCCCGCAAG-3'    (SEQ ID NO: 2338)

5'-GUUUCCUUCUCUGGAGCUUCCCGCA-3'      (SEQ ID NO: 2744)
                  3'-UUCAAAGGAAGAGACCUCGAAGGGCGU-5'    (SEQ ID NO: 1934)

AR-1000 Target:   5'-AAGTTTCCTTCTCTGGAGCTTCCCGCA-3'    (SEQ ID NO: 2339)

5'-CUUCCCGCAGGUGGGCAGCUAGCUG-3'      (SEQ ID NO: 2745)
                  3'-UCGAAGGGCGUCCACCCGUCGAUCGAC-5'    (SEQ ID NO: 1935)

AR-1016 Target:   5'-AGCTTCCCGCAGGTGGGCAGCTAGCTG-3'    (SEQ ID NO: 2340)

5'-GGGCAGCUAGCUGCAGCGACUACCG-3'      (SEQ ID NO: 2746)
                  3'-CACCCGUCGAUCGACGUCGCUGAUGGC-5'    (SEQ ID NO: 1936)

AR-1028 Target:   5'-GTGGGCAGCTAGCTGCAGCGACTACCG-3'    (SEQ ID NO: 2341)

5'-GUGCAGUUAGGGCUGGGAAGGGUCU-3'      (SEQ ID NO: 2747)
                  3'-UUCACGUCAAUCCCGACCCUUCCCAGA-5'    (SEQ ID NO: 1937)
```

TABLE 11-continued

AR Duplexes, Unmodified forms of Tested Duplexes, Human

```
AR-1146 Target:  5'-AAGTGCAGTTAGGGCTGGGAAGGGTCT-3'     (SEQ ID NO: 2342)

5'-UGCAGUUAGGGCUGGGAAGGGUCUA-3'      (SEQ ID NO: 2748)
                 3'-UCACGUCAAUCCCGACCCUUCCCAGAU-5'    (SEQ ID NO: 1938)

AR-1147 Target:  5'-AGTGCAGTTAGGGCTGGGAAGGGTCTA-3'    (SEQ ID NO: 2343)

5'-GCAGUUAGGGCUGGGAAGGGUCUAC-3'      (SEQ ID NO: 2749)
                 3'-CACGUCAAUCCCGACCCUUCCCAGAUG-5'    (SEQ ID NO: 1939)

AR-1148 Target:  5'-GTGCAGTTAGGGCTGGGAAGGGTCTAC-3'    (SEQ ID NO: 2344)

5'-CAGUUAGGGCUGGGAAGGGUCUACC-3'      (SEQ ID NO: 2750)
                 3'-ACGUCAAUCCCGACCCUUCCCAGAUGG-5'    (SEQ ID NO: 1940)

AR-1149 Target:  5'-TGCAGTTAGGGCTGGGAAGGGTCTACC-3'    (SEQ ID NO: 2345)

5'-AGUUAGGGCUGGGAAGGGUCUACCC-3'      (SEQ ID NO: 2751)
                 3'-CGUCAAUCCCGACCCUUCCCAGAUGGG-5'    (SEQ ID NO: 1941)

AR-1150 Target:  5'-GCAGTTAGGGCTGGGAAGGGTCTACCC-3'    (SEQ ID NO: 2346)

5'-GUUAGGGCUGGGAAGGGUCUACCCU-3'      (SEQ ID NO: 2752)
                 3'-GUCAAUCCCGACCCUUCCCAGAUGGGA-5'    (SEQ ID NO: 1942)

AR-1151 Target:  5'-CAGTTAGGGCTGGGAAGGGTCTACCCT-3'    (SEQ ID NO: 2347)

5'-UUAGGGCUGGGAAGGGUCUACCCUC-3'      (SEQ ID NO: 2753)
                 3'-UCAAUCCCGACCCUUCCCAGAUGGGAG-5'    (SEQ ID NO: 1943)

AR-1152 Target:  5'-AGTTAGGGCTGGGAAGGGTCTACCCTC-3'    (SEQ ID NO: 2348)

5'-UAGGGCUGGGAAGGGUCUACCCUCG-3'      (SEQ ID NO: 2754)
                 3'-CAAUCCCGACCCUUCCCAGAUGGGAGC-5'    (SEQ ID NO: 1944)

AR-1153 Target:  5'-GTTAGGGCTGGGAAGGGTCTACCCTCG-3'    (SEQ ID NO: 2349)

5'-AGGGCUGGGAAGGGUCUACCCUCGG-3'      (SEQ ID NO: 2755)
                 3'-AAUCCCGACCCUUCCCAGAUGGGAGCC-5'    (SEQ ID NO: 1945)

AR-1154 Target:  5'-TTAGGGCTGGGAAGGGTCTACCCTCGG-3'    (SEQ ID NO: 2350)

5'-GGGCUGGGAAGGGUCUACCCUCGGC-3'      (SEQ ID NO: 2756)
                 3'-AUCCCGACCCUUCCCAGAUGGGAGCCG-5'    (SEQ ID NO: 1946)

AR-1155 Target:  5'-TAGGGCTGGGAAGGGTCTACCCTCGGC-3'    (SEQ ID NO: 2351)

5'-GGCUGGGAAGGGUCUACCCUCGGCC-3'      (SEQ ID NO: 2757)
                 3'-UCCCGACCCUUCCCAGAUGGGAGCCGG-5'    (SEQ ID NO: 1947)

AR-1156 Target:  5'-AGGGCTGGGAAGGGTCTACCCTCGGCC-3'    (SEQ ID NO: 2352)

5'-UUCCAGAAUCUGUUCCAGAGCGUGC-3'      (SEQ ID NO: 2758)
                 3'-GAAAGGUCUUAGACAAGGUCUCGCACG-5'    (SEQ ID NO: 1948)

AR-1206 Target:  5'-CTTTCCAGAATCTGTTCCAGAGCGTGC-3'    (SEQ ID NO: 2353)

5'-UCCAGAAUCUGUUCCAGAGCGUGCG-3'      (SEQ ID NO: 2759)
                 3'-AAAGGUCUUAGACAAGGUCUCGCACGC-5'    (SEQ ID NO: 1949)

AR-1207 Target:  5'-TTTCCAGAATCTGTTCCAGAGCGTGCG-3'    (SEQ ID NO: 2354)

5'-CCAGAAUCUGUUCCAGAGCGUGCGC-3'      (SEQ ID NO: 2760)
                 3'-AAGGUCUUAGACAAGGUCUCGCACGCG-5'    (SEQ ID NO: 1950)

AR-1208 Target:  5'-TTCCAGAATCTGTTCCAGAGCGTGCGC-3'    (SEQ ID NO: 2355)

5'-CAGAAUCUGUUCCAGAGCGUGCGCG-3'      (SEQ ID NO: 2761)
                 3'-AGGUCUUAGACAAGGUCUCGCACGCGC-5'    (SEQ ID NO: 1951)

AR-1209 Target:  5'-TCCAGAATCTGTTCCAGAGCGTGCGCG-3'    (SEQ ID NO: 2356)

5'-AGAAUCUGUUCCAGAGCGUGCGCGA-3'      (SEQ ID NO: 2762)
                 3'-GGUCUUAGACAAGGUCUCGCACGCGCU-5'    (SEQ ID NO: 1952)
```

TABLE 11-continued

AR Duplexes, Unmodified forms of Tested Duplexes, Human

```
AR-1210 Target:   5'-CCAGAATCTGTTCCAGAGCGTGCGCGA-3'    (SEQ ID NO: 2357)

5'-GAAUCUGUUCCAGAGCGUGCGCGAA-3'     (SEQ ID NO: 2763)
                  3'-GUCUUAGACAAGGUCUCGCACGCGCUU-5'   (SEQ ID NO: 1953)

AR-1211 Target:   5'-CAGAATCTGTTCCAGAGCGTGCGCGAA-3'   (SEQ ID NO: 2358)

5'-AAUCUGUUCCAGAGCGUGCGCGAAG-3'    (SEQ ID NO: 2764)
                  3'-UCUUAGACAAGGUCUCGCACGCGCUUC-5'  (SEQ ID NO: 1954)

AR-1212 Target:   5'-AGAATCTGTTCCAGAGCGTGCGCGAAG-3'   (SEQ ID NO: 2359)

5'-AUCUGUUCCAGAGCGUGCGCGAAGU-3'    (SEQ ID NO: 2765)
                  3'-CUUAGACAAGGUCUCGCACGCGCUUCA-5'  (SEQ ID NO: 1955)

AR-1213 Target:   5'-GAATCTGTTCCAGAGCGTGCGCGAAGT-3'   (SEQ ID NO: 2360)

5'-UCUGUUCCAGAGCGUGCGCGAAGUG-3'    (SEQ ID NO: 2766)
                  3'-UUAGACAAGGUCUCGCACGCGCUUCAC-5'  (SEQ ID NO: 1956)

AR-1214 Target:   5'-AATCTGTTCCAGAGCGTGCGCGAAGTG-3'   (SEQ ID NO: 2361)

5'-CUGUUCCAGAGCGUGCGCGAAGUGA-3'    (SEQ ID NO: 2767)
                  3'-UAGACAAGGUCUCGCACGCGCUUCACU-5'  (SEQ ID NO: 1957)

AR-1215 Target:   5'-ATCTGTTCCAGAGCGTGCGCGAAGTGA-3'   (SEQ ID NO: 2362)

5'-UGUUCCAGAGCGUGCGCGAAGUGAU-3'    (SEQ ID NO: 2768)
                  3'-AGACAAGGUCUCGCACGCGCUUCACUA-5'  (SEQ ID NO: 1958)

AR-1216 Target:   5'-TCTGTTCCAGAGCGTGCGCGAAGTGAT-3'   (SEQ ID NO: 2363)

5'-GUUCCAGAGCGUGCGCGAAGUGAUC-3'    (SEQ ID NO: 2769)
                  3'-GACAAGGUCUCGCACGCGCUUCACUAG-5'  (SEQ ID NO: 1959)

AR-1217 Target:   5'-CTGTTCCAGAGCGTGCGCGAAGTGATC-3'   (SEQ ID NO: 2364)

5'-UUCCAGAGCGUGCGCGAAGUGAUCC-3'    (SEQ ID NO: 2770)
                  3'-ACAAGGUCUCGCACGCGCUUCACUAGG-5'  (SEQ ID NO: 1960)

AR-1218 Target:   5'-TGTTCCAGAGCGTGCGCGAAGTGATCC-3'   (SEQ ID NO: 2365)

5'-CGCCAGUUUGCUGCUGCUGCAGCAG-3'    (SEQ ID NO: 2771)
                  3'-CCGCGGUCAAACGACGACGACGUCGUC-5'  (SEQ ID NO: 1961)

AR-1292 Target:   5'-GGCGCCAGTTTGCTGCTGCTGCAGCAG-3'   (SEQ ID NO: 2366)

5'-GCUGCUGCUGCAGCAGCAGCAGCAG-3'    (SEQ ID NO: 2772)
                  3'-AACGACGACGACGUCGUCGUCGUCGUC-5'  (SEQ ID NO: 1962)

AR-1301 Target:   5'-TTGCTGCTGCTGCAGCAGCAGCAGCAG-3'   (SEQ ID NO: 2367)

5'-GUCCCAGAGCCUGGAGCCGCCGUGG-3'    (SEQ ID NO: 2773)
                  3'-CGCAGGGUCUCGGACCUCGGCGGCACC-5'  (SEQ ID NO: 1963)

AR-1533 Target:   5'-GCGTCCCAGAGCCTGGAGCCGCCGTGG-3'   (SEQ ID NO: 2368)

5'-CUGCCGCAGCAGCUGCCAGCACCUC-3'    (SEQ ID NO: 2774)
                  3'-CCGACGGCGUCGUCGACGGUCGUGGAG-5'  (SEQ ID NO: 1964)

AR-1572 Target:   5'-GGCTGCCGCAGCAGCTGCCAGCACCTC-3'   (SEQ ID NO: 2369)

5'-CAGCAGCUGCCAGCACCUCCGGACG-3'    (SEQ ID NO: 2775)
                  3'-GCGUCGUCGACGGUCGUGGAGGCCUGC-5'  (SEQ ID NO: 1965)

AR-1578 Target:   5'-CGCAGCAGCTGCCAGCACCTCCGGACG-3'   (SEQ ID NO: 2370)

5'-CAUCCACGUUGUCCCUGCUGGGCCC-3'    (SEQ ID NO: 2776)
                  3'-GGGUAGGUGCAACAGGGACGACCCGGG-5'  (SEQ ID NO: 1966)

AR-1621 Target:   5'-CCCATCCACGTTGTCCCTGCTGGGCCC-3'   (SEQ ID NO: 2371)

5'-GGCUUAAGCAGCUGCUCCGCUGACC-3'    (SEQ ID NO: 2777)
                  3'-GGCCGAAUUCGUCGACGAGGCGACUGG-5'  (SEQ ID NO: 1967)
```

TABLE 11-continued

AR Duplexes, Unmodified forms of Tested Duplexes, Human

```
AR-1656 Target:   5'-CCGGCTTAAGCAGCTGCTCCGCTGACC-3'    (SEQ ID NO: 2372)

5'-GCUUAAGCAGCUGCUCCGCUGACCU-3'     (SEQ ID NO: 2778)
                  3'-GCCGAAUUCGUCGACGAGGCGACUGGA-5'   (SEQ ID NO: 1968)

AR-1657 Target:   5'-CGGCTTAAGCAGCTGCTCCGCTGACCT-3'   (SEQ ID NO: 2373)

5'-AGCAGCUGCUCCGCUGACCUUAAAG-3'    (SEQ ID NO: 2779)
                  3'-AUUCGUCGACGAGGCGACUGGAAUUUC-5'  (SEQ ID NO: 1969)

AR-1662 Target:   5'-TAAGCAGCTGCTCCGCTGACCTTAAAG-3'  (SEQ ID NO: 2374)

5'-GCAACUCCUUCAGCAACAGCAGCAG-3'    (SEQ ID NO: 2780)
                  3'-UACGUUGAGGAAGUCGUUGUCGUCGUC-5'  (SEQ ID NO: 1970)

AR-1712 Target:   5'-ATGCAACTCCTTCAGCAACAGCAGCAG-3'  (SEQ ID NO: 2375)

5'-CAUUUCUGACAACGCCAAGGAGUUG-3'    (SEQ ID NO: 2781)
                  3'-UGGUAAAGACUGUUGCGGUUCCUCAAC-5'  (SEQ ID NO: 1971)

AR-1832 Target:   5'-ACCATTTCTGACAACGCCAAGGAGTTG-3'  (SEQ ID NO: 2376)

5'-ACUUUUGGGAGUUCCACCCGCUGUG-3'    (SEQ ID NO: 2782)
                  3'-GGUGAAAACCCUCAAGGUGGGCGACAC-5'  (SEQ ID NO: 1972)

AR-1952 Target:   5'-CCACTTTTGGGAGTTCCACCCGCTGTG-3'  (SEQ ID NO: 2377)

5'-GGCAAGAGCACUGAAGAUACUGCUG-3'    (SEQ ID NO: 2783)
                  3'-GUCCGUUCUCGUGACUUCUAUGACGAC-5'  (SEQ ID NO: 1973)

AR-2037 Target:   5'-CAGGCAAGAGCACTGAAGATACTGCTG-3'  (SEQ ID NO: 2378)

5'-GGCAGCGCUGCAGCAGGGAGCUCCG-3'    (SEQ ID NO: 2784)
                  3'-GACCGUCGCGACGUCGUCCCUCGAGGC-5'  (SEQ ID NO: 1974)

AR-2124 Target:   5'-CTGGCAGCGCTGCAGCAGGGAGCTCCG-3'  (SEQ ID NO: 2379)

5'-UCGCGACUACUACAACUUUCCACUG-3'    (SEQ ID NO: 2785)
                  3'-UCAGCGCUGAUGAUGUUGAAAGGUGAC-5'  (SEQ ID NO: 1975)

AR-2222 Target:   5'-AGTCGCGACTACTACAACTTTCCACTG-3'  (SEQ ID NO: 2380)

5'-CGCGACUACUACAACUUUCCACUGG-3'    (SEQ ID NO: 2786)
                  3'-CAGCGCUGAUGAUGUUGAAAGGUGACC-5'  (SEQ ID NO: 1976)

AR-2223 Target:   5'-GTCGCGACTACTACAACTTTCCACTGG-3'  (SEQ ID NO: 2381)

5'-GCGACUACUACAACUUUCCACUGGC-3'    (SEQ ID NO: 2787)
                  3'-AGCGCUGAUGAUGUUGAAAGGUGACCG-5'  (SEQ ID NO: 1977)

AR-2224 Target:   5'-TCGCGACTACTACAACTTTCCACTGGC-3'  (SEQ ID NO: 2382)

5'-UCGCAUCAAGCUGGAGAACCCGCUG-3'    (SEQ ID NO: 2788)
                  3'-CGAGCGUAGUUCGACCUCUUGGGCGAC-5'  (SEQ ID NO: 1978)

AR-2294 Target:   5'-GCTCGCATCAAGCTGGAGAACCCGCTG-3'  (SEQ ID NO: 2383)

5'-UGGACUACGGCAGCGCCUGGGCGGC-3'    (SEQ ID NO: 2789)
                  3'-CGACCUGAUGCCGUCGCGGACCCGCCG-5'  (SEQ ID NO: 1979)

AR-2317 Target:   5'-GCTGGACTACGGCAGCGCCTGGGCGGC-3'  (SEQ ID NO: 2384)

5'-GGACUACGGCAGCGCCUGGGCGGCU-3'    (SEQ ID NO: 2790)
                  3'-GACCUGAUGCCGUCGCGGACCCGCCGA-5'  (SEQ ID NO: 1980)

AR-2318 Target:   5'-CTGGACTACGGCAGCGCCTGGGCGGCT-3'  (SEQ ID NO: 2385)

5'-GACUACGGCAGCGCCUGGGCGGCUG-3'    (SEQ ID NO: 2791)
                  3'-ACCUGAUGCCGUCGCGGACCCGCCGAC-5'  (SEQ ID NO: 1981)

AR-2319 Target:   5'-TGGACTACGGCAGCGCCTGGGCGGCTG-3'  (SEQ ID NO: 2386)

5'-ACUACGGCAGCGCCUGGGCGGCUGC-3'    (SEQ ID NO: 2792)
                  3'-CCUGAUGCCGUCGCGGACCCGCCGACG-5'  (SEQ ID NO: 1982)
```

TABLE 11-continued

AR Duplexes, Unmodified forms of Tested Duplexes, Human

```
AR-2320 Target:   5'-GGACTACGGCAGCGCCTGGGCGGCTGC-3'   (SEQ ID NO: 2387)

5'-GCGCGGGUGCAGCGGGACCCGGUUC-3'    (SEQ ID NO: 2793)
                  3'-ACCGCGCCCACGUCGCCCUGGGCCAAG-5'  (SEQ ID NO: 1983)

AR-2386 Target:   5'-TGGCGCGGGTGCAGCGGGACCCGGTTC-3'   (SEQ ID NO: 2388)

5'-CUGGCGGGCCAGGAAAGCGACUUCA-3'    (SEQ ID NO: 2794)
                  3'-CCGACCGCCCGGUCCUUUCGCUGAAGU-5'  (SEQ ID NO: 1984)

AR-2607 Target:   5'-GGCTGGCGGGCCAGGAAAGCGACTTCA-3'   (SEQ ID NO: 2389)

5'-ACCCUGGCGGCAUGGUGAGCAGAGU-3'    (SEQ ID NO: 2795)
                  3'-CAUGGGACCGCCGUACCACUCGUCUCA-5'  (SEQ ID NO: 1985)

AR-2650 Target:   5'-GTACCCTGGCGGCATGGTGAGCAGAGT-3'   (SEQ ID NO: 2390)

5'-GAUGGAUAGCUACUCCGGACCUUAC-3'    (SEQ ID NO: 2796)
                  3'-ACCUACCUAUCGAUGAGGCCUGGAAUG-5'  (SEQ ID NO: 1986)

AR-2720 Target:   5'-TGGATGGATAGCTACTCCGGACCTTAC-3'   (SEQ ID NO: 2391)

5'-CAGAAGACCUGCCUGAUCUGUGGAG-3'    (SEQ ID NO: 2797)
                  3'-GGGUCUUCUGGACGGACUAGACACCUC-5'  (SEQ ID NO: 1987)

AR-2808 Target:   5'-CCCAGAAGACCTGCCTGATCTGTGGAG-3'   (SEQ ID NO: 2392)

5'-AGAAGACCUGCCUGAUCUGUGGAGA-3'    (SEQ ID NO: 2798)
                  3'-GGUCUUCUGGACGGACUAGACACCUCU-5'  (SEQ ID NO: 1988)

AR-2809 Target:   5'-CCAGAAGACCTGCCTGATCTGTGGAGA-3'   (SEQ ID NO: 2393)

5'-GAAGACCUGCCUGAUCUGUGGAGAU-3'    (SEQ ID NO: 2799)
                  3'-GUCUUCUGGACGGACUAGACACCUCUA-5'  (SEQ ID NO: 1989)

AR-2810 Target:   5'-CAGAAGACCTGCCTGATCTGTGGAGAT-3'   (SEQ ID NO: 2394)

5'-AAGACCUGCCUGAUCUGUGGAGAUG-3'    (SEQ ID NO: 2800)
                  3'-UCUUCUGGACGGACUAGACACCUCUAC-5'  (SEQ ID NO: 1990)

AR-2811 Target:   5'-AGAAGACCTGCCTGATCTGTGGAGATG-3'   (SEQ ID NO: 2395)

5'-AGACCUGCCUGAUCUGUGGAGAUGA-3'    (SEQ ID NO: 2801)
                  3'-CUUCUGGACGGACUAGACACCUCUACU-5'  (SEQ ID NO: 1991)

AR-2812 Target:   5'-GAAGACCTGCCTGATCTGTGGAGATGA-3'   (SEQ ID NO: 2396)

5'-GACCUGCCUGAUCUGUGGAGAUGAA-3'    (SEQ ID NO: 2802)
                  3'-UUCUGGACGGACUAGACACCUCUACUU-5'  (SEQ ID NO: 1992)

AR-2813 Target:   5'-AAGACCTGCCTGATCTGTGGAGATGAA-3'   (SEQ ID NO: 2397)

5'-ACCUGCCUGAUCUGUGGAGAUGAAG-3'    (SEQ ID NO: 2803)
                  3'-UCUGGACGGACUAGACACCUCUACUUC-5'  (SEQ ID NO: 1993)

AR-2814 Target:   5'-AGACCTGCCTGATCTGTGGAGATGAAG-3'   (SEQ ID NO: 2398)

5'-CCUGCCUGAUCUGUGGAGAUGAAGC-3'    (SEQ ID NO: 2804)
                  3'-CUGGACGGACUAGACACCUCUACUUCG-5'  (SEQ ID NO: 1994)

AR-2815 Target:   5'-GACCTGCCTGATCTGTGGAGATGAAGC-3'   (SEQ ID NO: 2399)

5'-CUGCCUGAUCUGUGGAGAUGAAGCU-3'    (SEQ ID NO: 2805)
                  3'-UGGACGGACUAGACACCUCUACUUCGA-5'  (SEQ ID NO: 1995)

AR-2816 Target:   5'-ACCTGCCTGATCTGTGGAGATGAAGCT-3'   (SEQ ID NO: 2400)

5'-UGCCUGAUCUGUGGAGAUGAAGCUU-3'    (SEQ ID NO: 2806)
                  3'-GGACGGACUAGACACCUCUACUUCGAA-5'  (SEQ ID NO: 1996)

AR-2817 Target:   5'-CCTGCCTGATCTGTGGAGATGAAGCTT-3'   (SEQ ID NO: 2401)

5'-GCCUGAUCUGUGGAGAUGAAGCUUC-3'    (SEQ ID NO: 2807)
                  3'-GACGGACUAGACACCUCUACUUCGAAG-5'  (SEQ ID NO: 1997)
```

TABLE 11-continued

AR Duplexes, Unmodified forms of Tested Duplexes, Human

```
AR-2818  Target:  5'-CTGCCTGATCTGTGGAGATGAAGCTTC-3'      (SEQ ID NO: 2402)

5'-CCUGAUCUGUGGAGAUGAAGCUUCU-3'        (SEQ ID NO: 2808)
                  3'-ACGGACUAGACACCUCUACUUCGAAGA-5'      (SEQ ID NO: 1998)

AR-2819  Target:  5'-TGCCTGATCTGTGGAGATGAAGCTTCT-3'      (SEQ ID NO: 2403)

5'-CUGAUCUGUGGAGAUGAAGCUUCUG-3'        (SEQ ID NO: 2809)
                  3'-CGGACUAGACACCUCUACUUCGAAGAC-5'      (SEQ ID NO: 1999)

AR-2820  Target:  5'-GCCTGATCTGTGGAGATGAAGCTTCTG-3'      (SEQ ID NO: 2404)

5'-UGAUCUGUGGAGAUGAAGCUUCUGG-3'        (SEQ ID NO: 2810)
                  3'-GGACUAGACACCUCUACUUCGAAGACC-5'      (SEQ ID NO: 2000)

AR-2821  Target:  5'-CCTGATCTGTGGAGATGAAGCTTCTGG-3'      (SEQ ID NO: 2405)

5'-GAUCUGUGGAGAUGAAGCUUCUGGG-3'        (SEQ ID NO: 2811)
                  3'-GACUAGACACCUCUACUUCGAAGACCC-5'      (SEQ ID NO: 2001)

AR-2822  Target:  5'-CTGATCTGTGGAGATGAAGCTTCTGGG-3'      (SEQ ID NO: 2406)

5'-AUCUGUGGAGAUGAAGCUUCUGGGU-3'        (SEQ ID NO: 2812)
                  3'-ACUAGACACCUCUACUUCGAAGACCCA-5'      (SEQ ID NO: 2002)

AR-2823  Target:  5'-TGATCTGTGGAGATGAAGCTTCTGGGT-3'      (SEQ ID NO: 2407)

5'-UCUGUGGAGAUGAAGCUUCUGGGUG-3'        (SEQ ID NO: 2813)
                  3'-CUAGACACCUCUACUUCGAAGACCCAC-5'      (SEQ ID NO: 2003)

AR-2824  Target:  5'-GATCTGTGGAGATGAAGCTTCTGGGTG-3'      (SEQ ID NO: 2408)

5'-CUGUGGAGAUGAAGCUUCUGGGUGU-3'        (SEQ ID NO: 2814)
                  3'-UAGACACCUCUACUUCGAAGACCCACA-5'      (SEQ ID NO: 2004)

AR-2825  Target:  5'-ATCTGTGGAGATGAAGCTTCTGGGTGT-3'      (SEQ ID NO: 2409)

5'-UGUGGAGAUGAAGCUUCUGGGUGUC-3'        (SEQ ID NO: 2815)
                  3'-AGACACCUCUACUUCGAAGACCCACAG-5'      (SEQ ID NO: 2005)

AR-2826  Target:  5'-TCTGTGGAGATGAAGCTTCTGGGTGTC-3'      (SEQ ID NO: 2410)

5'-GUGGAGAUGAAGCUUCUGGGUGUCA-3'        (SEQ ID NO: 2816)
                  3'-GACACCUCUACUUCGAAGACCCACAGU-5'      (SEQ ID NO: 2006)

AR-2827  Target:  5'-CTGTGGAGATGAAGCTTCTGGGTGTCA-3'      (SEQ ID NO: 2411)

5'-UUCUGGGUGUCACUAUGGAGCUCUC-3'        (SEQ ID NO: 2817)
                  3'-CGAAGACCCACAGUAUACCUCGAGAG-5'       (SEQ ID NO: 2007)

AR-2840  Target:  5'-GCTTCTGGGTGTCACTATGGAGCTCTC-3'      (SEQ ID NO: 2412)

5'-GAGCUCUCACAUGUGGAAGCUGCAA-3'        (SEQ ID NO: 2818)
                  3'-ACCUCGAGAGUGUACACCUUCGACGUU-5'      (SEQ ID NO: 2008)

AR-2857  Target:  5'-TGGAGCTCTCACATGTGGAAGCTGCAA-3'      (SEQ ID NO: 2413)

5'-AGCUGCAAGGUCUUCUUCAAAAGAG-3'        (SEQ ID NO: 2819)
                  3'-CUUCGACGUUCCAGAAGAAGUUUUCUC-5'      (SEQ ID NO: 2009)

AR-2874  Target:  5'-GAAGCTGCAAGGTCTTCTTCAAAAGAG-3'      (SEQ ID NO: 2414)

5'-GCUGCAAGGUCUUCUUCAAAAGAGC-3'        (SEQ ID NO: 2820)
                  3'-UUCGACGUUCCAGAAGAAGUUUUCUCG-5'      (SEQ ID NO: 2010)

AR-2875  Target:  5'-AAGCTGCAAGGTCTTCTTCAAAAGAGC-3'      (SEQ ID NO: 2415)

5'-CUGCAAGGUCUUCUUCAAAAGAGCC-3'        (SEQ ID NO: 2821)
                  3'-UCGACGUUCCAGAAGAAGUUUUCUCGG-5'      (SEQ ID NO: 2011)

AR-2876  Target:  5'-AGCTGCAAGGTCTTCTTCAAAAGAGCC-3'      (SEQ ID NO: 2416)

5'-UGCAAGGUCUUCUUCAAAAGAGCCG-3'        (SEQ ID NO: 2822)
                  3'-CGACGUUCCAGAAGAAGUUUUCUCGGC-5'      (SEQ ID NO: 2012)
```

TABLE 11-continued

AR Duplexes, Unmodified forms of Tested Duplexes, Human

```
AR-2877 Target:  5'-GCTGCAAGGTCTTCTTCAAAAGAGCCG-3'   (SEQ ID NO: 2417)

5'-GCAAGGUCUUCUUCAAAAGAGCCGC-3'    (SEQ ID NO: 2823)
                 3'-GACGUUCCAGAAGAAGUUUUCUCGGCG-5'  (SEQ ID NO: 2013)

AR-2878 Target:  5'-CTGCAAGGTCTTCTTCAAAAGAGCCGC-3'  (SEQ ID NO: 2418)

5'-CAAGGUCUUCUUCAAAAGAGCCGCU-3'   (SEQ ID NO: 2824)
                 3'-ACGUUCCAGAAGAAGUUUUCUCGGCGA-5' (SEQ ID NO: 2014)

AR-2879 Target:  5'-TGCAAGGTCTTCTTCAAAAGAGCCGCT-3'  (SEQ ID NO: 2419)

5'-AAGGUCUUCUUCAAAAGAGCCGCUG-3'   (SEQ ID NO: 2825)
                 3'-CGUUCCAGAAGAAGUUUUCUCGGCGAC-5' (SEQ ID NO: 2015)

AR-2880 Target:  5'-GCAAGGTCTTCTTCAAAAGAGCCGCTG-3'  (SEQ ID NO: 2420)

5'-AGGUCUUCUUCAAAAGAGCCGCUGA-3'   (SEQ ID NO: 2826)
                 3'-GUUCCAGAAGAAGUUUUCUCGGCGACU-5' (SEQ ID NO: 2016)

AR-2881 Target:  5'-CAAGGTCTTCTTCAAAAGAGCCGCTGA-3'  (SEQ ID NO: 2421)

5'-GGUCUUCUUCAAAAGAGCCGCUGAA-3'   (SEQ ID NO: 2827)
                 3'-UUCCAGAAGAAGUUUUCUCGGCGACUU-5' (SEQ ID NO: 2017)

AR-2882 Target:  5'-AAGGTCTTCTTCAAAAGAGCCGCTGAA-3'  (SEQ ID NO: 2422)

5'-GUCUUCUUCAAAAGAGCCGCUGAAG-3'   (SEQ ID NO: 2828)
                 3'-UCCAGAAGAAGUUUUCUCGGCGACUUC-5' (SEQ ID NO: 2018)

AR-2883 Target:  5'-AGGTCTTCTTCAAAAGAGCCGCTGAAG-3'  (SEQ ID NO: 2423)

5'-UCUUCUUCAAAAGAGCCGCUGAAGG-3'   (SEQ ID NO: 2829)
                 3'-CCAGAAGAAGUUUUCUCGGCGACUUCC-5' (SEQ ID NO: 2019)

AR-2884 Target:  5'-GGTCTTCTTCAAAAGAGCCGCTGAAGG-3'  (SEQ ID NO: 2424)

5'-CUUCUUCAAAAGAGCCGCUGAAGGG-3'   (SEQ ID NO: 2830)
                 3'-CAGAAGAAGUUUUCUCGGCGACUUCCC-5' (SEQ ID NO: 2020)

AR-2885 Target:  5'-GTCTTCTTCAAAAGAGCCGCTGAAGGG-3'  (SEQ ID NO: 2425)

5'-UUCUUCAAAAGAGCCGCUGAAGGGA-3'   (SEQ ID NO: 2831)
                 3'-AGAAGAAGUUUUCUCGGCGACUUCCCU-5' (SEQ ID NO: 2021)

AR-2886 Target:  5'-TCTTCTTCAAAAGAGCCGCTGAAGGGA-3'  (SEQ ID NO: 2426)

5'-UCUUCAAAAGAGCCGCUGAAGGGAA-3'   (SEQ ID NO: 2832)
                 3'-GAAGAAGUUUUCUCGGCGACUUCCCUU-5' (SEQ ID NO: 2022)

AR-2887 Target:  5'-CTTCTTCAAAAGAGCCGCTGAAGGGAA-3'  (SEQ ID NO: 2427)

5'-CUUCAAAAGAGCCGCUGAAGGGAAA-3'   (SEQ ID NO: 2833)
                 3'-AAGAAGUUUUCUCGGCGACUUCCCUUU-5' (SEQ ID NO: 2023)

AR-2888 Target:  5'-TTCTTCAAAAGAGCCGCTGAAGGGAAA-3'  (SEQ ID NO: 2428)

5'-UUCAAAAGAGCCGCUGAAGGGAAAC-3'   (SEQ ID NO: 2834)
                 3'-AGAAGUUUUCUCGGCGACUUCCCUUUG-5' (SEQ ID NO: 2024)

AR-2889 Target:  5'-TCTTCAAAAGAGCCGCTGAAGGGAAAC-3'  (SEQ ID NO: 2429)

5'-UCAAAAGAGCCGCUGAAGGGAAACA-3'   (SEQ ID NO: 2835)
                 3'-GAAGUUUUCUCGGCGACUUCCCUUUGU-5' (SEQ ID NO: 2025)

AR-2890 Target:  5'-CTTCAAAAGAGCCGCTGAAGGGAAACA-3'  (SEQ ID NO: 2430)

5'-CAAAAGAGCCGCUGAAGGGAAACAG-3'   (SEQ ID NO: 2836)
                 3'-AAGUUUUCUCGGCGACUUCCCUUUGUC-5' (SEQ ID NO: 2026)

AR-2891 Target:  5'-TTCAAAAGAGCCGCTGAAGGGAAACAG-3'  (SEQ ID NO: 2431)

5'-AAAAGAGCCGCUGAAGGGAAACAGA-3'   (SEQ ID NO: 2837)
                 3'-AGUUUUCUCGGCGACUUCCCUUUGUCU-5' (SEQ ID NO: 2027)
```

TABLE 11-continued

AR Duplexes, Unmodified forms of Tested Duplexes, Human

```
AR-2892 Target:  5'-TCAAAAGAGCCGCTGAAGGGAAACAGA-3'     (SEQ ID NO: 2432)

5'-AAAGAGCCGCUGAAGGGAAACAGAA-3'      (SEQ ID NO: 2838)
                 3'-GUUUUCUCGGCGACUUCCCUUUGUCUU-5'    (SEQ ID NO: 2028)

AR-2893 Target:  5'-CAAAAGAGCCGCTGAAGGGAAACAGAA-3'    (SEQ ID NO: 2433)

5'-AAGAGCCGCUGAAGGGAAACAGAAG-3'      (SEQ ID NO: 2839)
                 3'-UUUUCUCGGCGACUUCCCUUUGUCUUC-5'    (SEQ ID NO: 2029)

AR-2894 Target:  5'-AAAAGAGCCGCTGAAGGGAAACAGAAG-3'    (SEQ ID NO: 2434)

5'-AGAGCCGCUGAAGGGAAACAGAAGU-3'      (SEQ ID NO: 2840)
                 3'-UUUCUCGGCGACUUCCCUUUGUCUUCA-5'    (SEQ ID NO: 2030)

AR-2895 Target:  5'-AAAGAGCCGCTGAAGGGAAACAGAAGT-3'    (SEQ ID NO: 2435)

5'-GAGCCGCUGAAGGGAAACAGAAGUA-3'      (SEQ ID NO: 2841)
                 3'-UUCUCGGCGACUUCCCUUUGUCUUCAU-5'    (SEQ ID NO: 2031)

AR-2896 Target:  5'-AAGAGCCGCTGAAGGGAAACAGAAGTA-3'    (SEQ ID NO: 2436)

5'-AGCCGCUGAAGGGAAACAGAAGUAC-3'      (SEQ ID NO: 2842)
                 3'-UCUCGGCGACUUCCCUUUGUCUUCAUG-5'    (SEQ ID NO: 2032)

AR-2897 Target:  5'-AGAGCCGCTGAAGGGAAACAGAAGTAC-3'    (SEQ ID NO: 2437)

5'-GCCGCUGAAGGGAAACAGAAGUACC-3'      (SEQ ID NO: 2843)
                 3'-CUCGGCGACUUCCCUUUGUCUUCAUGG-5'    (SEQ ID NO: 2033)

AR-2898 Target:  5'-GAGCCGCTGAAGGGAAACAGAAGTACC-3'    (SEQ ID NO: 2438)

5'-CCGCUGAAGGGAAACAGAAGUACCU-3'      (SEQ ID NO: 2844)
                 3'-UCGGCGACUUCCCUUUGUCUUCAUGGA-5'    (SEQ ID NO: 2034)

AR-2899 Target:  5'-AGCCGCTGAAGGGAAACAGAAGTACCT-3'    (SEQ ID NO: 2439)

5'-GCUGAAGGGAAACAGAAGUACCUGU-3'      (SEQ ID NO: 2845)
                 3'-GGCGACUUCCCUUUGUCUUCAUGGACA-5'    (SEQ ID NO: 2035)

AR-2901 Target:  5'-CCGCTGAAGGGAAACAGAAGTACCTGT-3'    (SEQ ID NO: 2440)

5'-CUGAAGGGAAACAGAAGUACCUGUG-3'      (SEQ ID NO: 2846)
                 3'-GCGACUUCCCUUUGUCUUCAUGGACAC-5'    (SEQ ID NO: 2036)

AR-2902 Target:  5'-CGCTGAAGGGAAACAGAAGTACCTGTG-3'    (SEQ ID NO: 2441)

5'-UGUGCGCCAGCAGAAAUGAUUGCAC-3'      (SEQ ID NO: 2847)
                 3'-GGACACGCGGUCGUCUUUACUAACGUG-5'    (SEQ ID NO: 2037)

AR-2923 Target:  5'-CCTGTGCGCCAGCAGAAATGATTGCAC-3'    (SEQ ID NO: 2442)

5'-AGAAAUGAUUGCACUAUUGAUAAAU-3'      (SEQ ID NO: 2848)
                 3'-CGUCUUUACUAACGUGAUAACUAUUUA-5'    (SEQ ID NO: 2038)

AR-2934 Target:  5'-GCAGAAATGATTGCACTATTGATAAAT-3'    (SEQ ID NO: 2443)

5'-UGAUUGCACUAUUGAUAAAUUCCGA-3'      (SEQ ID NO: 2849)
                 3'-UUACUAACGUGAUAACUAUUUAAGGCU-5'    (SEQ ID NO: 2039)

AR-2939 Target:  5'-AATGATTGCACTATTGATAAATTCCGA-3'    (SEQ ID NO: 2444)

5'-CUAUUGAUAAAUUCCGAAGGAAAAA-3'      (SEQ ID NO: 2850)
                 3'-GUGAUAACUAUUUAAGGCUUCCUUUUU-5'    (SEQ ID NO: 2040)

AR-2947 Target:  5'-CACTATTGATAAATTCCGAAGGAAAAA-3'    (SEQ ID NO: 2445)

5'-CGGAAAUGUUAUGAAGCAGGGAUGA-3'      (SEQ ID NO: 2851)
                 3'-AAGCCUUUACAAUACUUCGUCCCUACU-5'    (SEQ ID NO: 2041)

AR-2991 Target:  5'-TTCGGAAATGTTATGAAGCAGGGATGA-3'    (SEQ ID NO: 2446)

5'-GGAAAUGUUAUGAAGCAGGGAUGAC-3'      (SEQ ID NO: 2852)
                 3'-AGCCUUUACAAUACUUCGUCCCUACUG-5'    (SEQ ID NO: 2042)
```

TABLE 11-continued

AR Duplexes, Unmodified forms of Tested Duplexes, Human

```
AR-2992 Target:  5'-TCGGAAATGTTATGAAGCAGGGATGAC-3'    (SEQ ID NO: 2447)

5'-GAAAUGUUAUGAAGCAGGGAUGACU-3'     (SEQ ID NO: 2853)
                 3'-GCCUUUACAAUACUUCGUCCCUACUGA-5'   (SEQ ID NO: 2043)

AR-2993 Target:  5'-CGGAAATGTTATGAAGCAGGGATGACT-3'   (SEQ ID NO: 2448)

5'-AAAUGUUAUGAAGCAGGGAUGACUC-3'    (SEQ ID NO: 2854)
                 3'-CCUUUACAAUACUUCGUCCCUACUGAG-5'   (SEQ ID NO: 2044)

AR-2994 Target:  5'-GGAAATGTTATGAAGCAGGGATGACTC-3'   (SEQ ID NO: 2449)

5'-AAUGUUAUGAAGCAGGGAUGACUCU-3'    (SEQ ID NO: 2855)
                 3'-CUUUACAAUACUUCGUCCCUACUGAGA-5'   (SEQ ID NO: 2045)

AR-2995 Target:  5'-GAAATGTTATGAAGCAGGGATGACTCT-3'   (SEQ ID NO: 2450)

5'-AUGUUAUGAAGCAGGGAUGACUCUG-3'    (SEQ ID NO: 2856)
                 3'-UUUACAAUACUUCGUCCCUACUGAGAC-5'   (SEQ ID NO: 2046)

AR-2996 Target:  5'-AAATGTTATGAAGCAGGGATGACTCTG-3'   (SEQ ID NO: 2451)

5'-UGUUAUGAAGCAGGGAUGACUCUGG-3'    (SEQ ID NO: 2857)
                 3'-UUACAAUACUUCGUCCCUACUGAGACC-5'   (SEQ ID NO: 2047)

AR-2997 Target:  5'-AATGTTATGAAGCAGGGATGACTCTGG-3'   (SEQ ID NO: 2452)

5'-GUUAUGAAGCAGGGAUGACUCUGGG-3'    (SEQ ID NO: 2858)
                 3'-UACAAUACUUCGUCCCUACUGAGACCC-5'   (SEQ ID NO: 2048)

AR-2998 Target:  5'-ATGTTATGAAGCAGGGATGACTCTGGG-3'   (SEQ ID NO: 2453)

5'-UUAUGAAGCAGGGAUGACUCUGGGA-3'    (SEQ ID NO: 2859)
                 3'-ACAAUACUUCGUCCCUACUGAGACCCU-5'   (SEQ ID NO: 2049)

AR-2999 Target:  5'-TGTTATGAAGCAGGGATGACTCTGGGA-3'   (SEQ ID NO: 2454)

5'-UAUGAAGCAGGGAUGACUCUGGGAG-3'    (SEQ ID NO: 2860)
                 3'-CAAUACUUCGUCCCUACUGAGACCCUC-5'   (SEQ ID NO: 2050)

AR-3000 Target:  5'-GTTATGAAGCAGGGATGACTCTGGGAG-3'   (SEQ ID NO: 2455)

5'-AUGAAGCAGGGAUGACUCUGGGAGC-3'    (SEQ ID NO: 2861)
                 3'-AAUACUUCGUCCCUACUGAGACCCUCG-5'   (SEQ ID NO: 2051)

AR-3001 Target:  5'-TTATGAAGCAGGGATGACTCTGGGAGC-3'   (SEQ ID NO: 2456)

5'-UGAAGCAGGGAUGACUCUGGGAGCC-3'    (SEQ ID NO: 2862)
                 3'-AUACUUCGUCCCUACUGAGACCCUCGG-5'   (SEQ ID NO: 2052)

AR-3002 Target:  5'-TATGAAGCAGGGATGACTCTGGGAGCC-3'   (SEQ ID NO: 2457)

5'-GAAGCAGGGAUGACUCUGGGAGCCC-3'    (SEQ ID NO: 2863)
                 3'-UACUUCGUCCCUACUGAGACCCUCGGG-5'   (SEQ ID NO: 2053)

AR-3003 Target:  5'-ATGAAGCAGGGATGACTCTGGGAGCCC-3'   (SEQ ID NO: 2458)

5'-AAGCAGGGAUGACUCUGGGAGCCCG-3'    (SEQ ID NO: 2864)
                 3'-ACUUCGUCCCUACUGAGACCCUCGGGC-5'   (SEQ ID NO: 2054)

AR-3004 Target:  5'-TGAAGCAGGGATGACTCTGGGAGCCCG-3'   (SEQ ID NO: 2459)

5'-AGCAGGGAUGACUCUGGGAGCCCGG-3'    (SEQ ID NO: 2865)
                 3'-CUUCGUCCCUACUGAGACCCUCGGGCC-5'   (SEQ ID NO: 2055)

AR-3005 Target:  5'-GAAGCAGGGATGACTCTGGGAGCCCGG-3'   (SEQ ID NO: 2460)

5'-GCAGGGAUGACUCUGGGAGCCCGGA-3'    (SEQ ID NO: 2866)
                 3'-UUCGUCCCUACUGAGACCCUCGGGCCU-5'   (SEQ ID NO: 2056)

AR-3006 Target:  5'-AAGCAGGGATGACTCTGGGAGCCCGGA-3'   (SEQ ID NO: 2461)

5'-CAGGGAUGACUCUGGGAGCCCGGAA-3'    (SEQ ID NO: 2867)
                 3'-UCGUCCCUACUGAGACCCUCGGGCCUU-5'   (SEQ ID NO: 2057)
```

TABLE 11-continued

AR Duplexes, Unmodified forms of Tested Duplexes, Human

```
AR-3007 Target:   5'-AGCAGGGATGACTCTGGGAGCCCGGAA-3'   (SEQ ID NO: 2462)

5'-GAAGAAACUUGGUAAUCUGAAACUA-3'     (SEQ ID NO: 2868)
                  3'-GACUUCUUUGAACCAUUAGACUUUGAU-5'   (SEQ ID NO: 2058)

AR-3035 Target:   5'-CTGAAGAAACTTGGTAATCTGAAACTA-3'   (SEQ ID NO: 2463)

5'-AAACUACAGGAGGAAGGAGAGGCUU-3'    (SEQ ID NO: 2869)
                  3'-ACUUUGAUGUCCUCCUUCCUCUCCGAA-5'   (SEQ ID NO: 2059)

AR-3054 Target:   5'-TGAAACTACAGGAGGAAGGAGAGGCTT-3'   (SEQ ID NO: 2464)

5'-AACUACAGGAGGAAGGAGAGGCUUC-3'    (SEQ ID NO: 2870)
                  3'-CUUUGAUGUCCUCCUUCCUCUCCGAAG-5'   (SEQ ID NO: 2060)

AR-3055 Target:   5'-GAAACTACAGGAGGAAGGAGAGGCTTC-3'   (SEQ ID NO: 2465)

5'-CAUUGAAGGCUAUGAAUGUCAGCCC-3'    (SEQ ID NO: 2871)
                  3'-GUGUAACUUCCGAUACUUACAGUCGGG-5'   (SEQ ID NO: 2061)

AR-3131 Target:   5'-CACATTGAAGGCTATGAATGTCAGCCC-3'   (SEQ ID NO: 2466)

5'-AUUGAAGGCUAUGAAUGUCAGCCCA-3'    (SEQ ID NO: 2872)
                  3'-UGUAACUUCCGAUACUUACAGUCGGGU-5'   (SEQ ID NO: 2062)

AR-3132 Target:   5'-ACATTGAAGGCTATGAATGTCAGCCCA-3'   (SEQ ID NO: 2467)

5'-UUGAAGGCUAUGAAUGUCAGCCCAU-3'    (SEQ ID NO: 2873)
                  3'-GUAACUUCCGAUACUUACAGUCGGGUA-5'   (SEQ ID NO: 2063)

AR-3133 Target:   5'-CATTGAAGGCTATGAATGTCAGCCCAT-3'   (SEQ ID NO: 2468)

5'-UGAAGGCUAUGAAUGUCAGCCCAUC-3'    (SEQ ID NO: 2874)
                  3'-UAACUUCCGAUACUUACAGUCGGGUAG-5'   (SEQ ID NO: 2064)

AR-3134 Target:   5'-ATTGAAGGCTATGAATGTCAGCCCATC-3'   (SEQ ID NO: 2469)

5'-GAAGGCUAUGAAUGUCAGCCCAUCU-3'    (SEQ ID NO: 2875)
                  3'-AACUUCCGAUACUUACAGUCGGGUAGA-5'   (SEQ ID NO: 2065)

AR-3135 Target:   5'-TTGAAGGCTATGAATGTCAGCCCATCT-3'   (SEQ ID NO: 2470)

5'-AAGGCUAUGAAUGUCAGCCCAUCUU-3'    (SEQ ID NO: 2876)
                  3'-ACUUCCGAUACUUACAGUCGGGUAGAA-5'   (SEQ ID NO: 2066)

AR-3136 Target:   5'-TGAAGGCTATGAATGTCAGCCCATCTT-3'   (SEQ ID NO: 2471)

5'-GUCCUGGAAGCCAUUGAGCCAGGUG-3'    (SEQ ID NO: 2877)
                  3'-UACAGGACCUUCGGUAACUCGGUCCAC-5'   (SEQ ID NO: 2067)

AR-3168 Target:   5'-ATGTCCTGGAAGCCATTGAGCCAGGTG-3'   (SEQ ID NO: 2472)

5'-UCCUGGAAGCCAUUGAGCCAGGUGU-3'    (SEQ ID NO: 2878)
                  3'-ACAGGACCUUCGGUAACUCGGUCCACA-5'   (SEQ ID NO: 2068)

AR-3169 Target:   5'-TGTCCTGGAAGCCATTGAGCCAGGTGT-3'   (SEQ ID NO: 2473)

5'-CCUGGAAGCCAUUGAGCCAGGUGUA-3'    (SEQ ID NO: 2879)
                  3'-CAGGACCUUCGGUAACUCGGUCCACAU-5'   (SEQ ID NO: 2069)

AR-3170 Target:   5'-GTCCTGGAAGCCATTGAGCCAGGTGTA-3'   (SEQ ID NO: 2474)

5'-CUGGAAGCCAUUGAGCCAGGUGUAG-3'    (SEQ ID NO: 2880)
                  3'-AGGACCUUCGGUAACUCGGUCCACAUC-5'   (SEQ ID NO: 2070)

AR-3171 Target:   5'-TCCTGGAAGCCATTGAGCCAGGTGTAG-3'   (SEQ ID NO: 2475)

5'-UGGAAGCCAUUGAGCCAGGUGUAGU-3'    (SEQ ID NO: 2881)
                  3'-GGACCUUCGGUAACUCGGUCCACAUCA-5'   (SEQ ID NO: 2071)

AR-3172 Target:   5'-CCTGGAAGCCATTGAGCCAGGTGTAGT-3'   (SEQ ID NO: 2476)

5'-CAGCCCGACUCCUUUGCAGCCUUGC-3'    (SEQ ID NO: 2882)
                  3'-UGGUCGGGCUGAGGAAACGUCGGAACG-5'   (SEQ ID NO: 2072)
```

TABLE 11-continued

AR Duplexes, Unmodified forms of Tested Duplexes, Human

```
AR-3219 Target:  5'-ACCAGCCCGACTCCTTTGCAGCCTTGC-3'    (SEQ ID NO: 2477)

5'-GACUCCUUUGCAGCCUUGCUCUCUA-3'     (SEQ ID NO: 2883)
                 3'-GGCUGAGGAAACGUCGGAACGAGAGAU-5'   (SEQ ID NO: 2073)

AR-3225 Target:  5'-CCGACTCCTTTGCAGCCTTGCTCTCTA-3'   (SEQ ID NO: 2478)

5'-CAGCCUUGCUCUCUAGCCUCAAUGA-3'     (SEQ ID NO: 2884)
                 3'-ACGUCGGAACGAGAGAUCGGAGUUACU-5'   (SEQ ID NO: 2074)

AR-3235 Target:  5'-TGCAGCCTTGCTCTCTAGCCTCAATGA-3'   (SEQ ID NO: 2479)

5'-GUGGUCAAGUGGGCCAAGGCCUUGC-3'     (SEQ ID NO: 2885)
                 3'-UGCACCAGUUCACCCGGUUCCGGAACG-5'   (SEQ ID NO: 2075)

AR-3285 Target:  5'-ACGTGGTCAAGTGGGCCAAGGCCTTGC-3'   (SEQ ID NO: 2480)

5'-UGGUCAAGUGGGCCAAGGCCUUGCC-3'     (SEQ ID NO: 2886)
                 3'-GCACCAGUUCACCCGGUUCCGGAACGG-5'   (SEQ ID NO: 2076)

AR-3286 Target:  5'-CGTGGTCAAGTGGGCCAAGGCCTTGCC-3'   (SEQ ID NO: 2481)

5'-GGUCAAGUGGGCCAAGGCCUUGCCU-3'     (SEQ ID NO: 2887)
                 3'-CACCAGUUCACCCGGUUCCGGAACGGA-5'   (SEQ ID NO: 2077)

AR-3287 Target:  5'-GTGGTCAAGTGGGCCAAGGCCTTGCCT-3'   (SEQ ID NO: 2482)

5'-GUCAAGUGGGCCAAGGCCUUGCCUG-3'     (SEQ ID NO: 2888)
                 3'-ACCAGUUCACCCGGUUCCGGAACGGAC-5'   (SEQ ID NO: 2078)

AR-3288 Target:  5'-TGGTCAAGTGGGCCAAGGCCTTGCCTG-3'   (SEQ ID NO: 2483)

5'-UCAAGUGGGCCAAGGCCUUGCCUGG-3'     (SEQ ID NO: 2889)
                 3'-CCAGUUCACCCGGUUCCGGAACGGACC-5'   (SEQ ID NO: 2079)

AR-3289 Target:  5'-GGTCAAGTGGGCCAAGGCCTTGCCTGG-3'   (SEQ ID NO: 2484)

5'-CAAGUGGGCCAAGGCCUUGCCUGGC-3'     (SEQ ID NO: 2890)
                 3'-CAGUUCACCCGGUUCCGGAACGGACCG-5'   (SEQ ID NO: 2080)

AR-3290 Target:  5'-GTCAAGTGGGCCAAGGCCTTGCCTGGC-3'   (SEQ ID NO: 2485)

5'-AAGUGGGCCAAGGCCUUGCCUGGCU-3'     (SEQ ID NO: 2891)
                 3'-AGUUCACCCGGUUCCGGAACGGACCGA-5'   (SEQ ID NO: 2081)

AR-3291 Target:  5'-TCAAGTGGGCCAAGGCCTTGCCTGGCT-3'   (SEQ ID NO: 2486)

5'-AGUGGGCCAAGGCCUUGCCUGGCUU-3'     (SEQ ID NO: 2892)
                 3'-GUUCACCCGGUUCCGGAACGGACCGAA-5'   (SEQ ID NO: 2082)

AR-3292 Target:  5'-CAAGTGGGCCAAGGCCTTGCCTGGCTT-3'   (SEQ ID NO: 2487)

5'-GUGGGCCAAGGCCUUGCCUGGCUUC-3'     (SEQ ID NO: 2893)
                 3'-UUCACCCGGUUCCGGAACGGACCGAAG-5'   (SEQ ID NO: 2083)

AR-3293 Target:  5'-AAGTGGGCCAAGGCCTTGCCTGGCTTC-3'   (SEQ ID NO: 2488)

5'-UGGGCCAAGGCCUUGCCUGGCUUCC-3'     (SEQ ID NO: 2894)
                 3'-UCACCCGGUUCCGGAACGGACCGAAGG-5'   (SEQ ID NO: 2084)

AR-3294 Target:  5'-AGTGGGCCAAGGCCTTGCCTGGCTTCC-3'   (SEQ ID NO: 2489)

5'-GGGCCAAGGCCUUGCCUGGCUUCCG-3'     (SEQ ID NO: 2895)
                 3'-CACCCGGUUCCGGAACGGACCGAAGGC-5'   (SEQ ID NO: 2085)

AR-3295 Target:  5'-GTGGGCCAAGGCCTTGCCTGGCTTCCG-3'   (SEQ ID NO: 2490)

5'-GGCCAAGGCCUUGCCUGGCUUCCGC-3'     (SEQ ID NO: 2896)
                 3'-ACCCGGUUCCGGAACGGACCGAAGGCG-5'   (SEQ ID NO: 2086)

AR-3296 Target:  5'-TGGGCCAAGGCCTTGCCTGGCTTCCGC-3'   (SEQ ID NO: 2491)

5'-GCCAAGGCCUUGCCUGGCUUCCGCA-3'     (SEQ ID NO: 2897)
                 3'-CCCGGUUCCGGAACGGACCGAAGGCGU-5'   (SEQ ID NO: 2087)
```

TABLE 11-continued

AR Duplexes, Unmodified forms of Tested Duplexes, Human

```
AR-3297 Target:   5'-GGGCCAAGGCCTTGCCTGGCTTCCGCA-3'    (SEQ ID NO: 2492)

5'-CCAAGGCCUUGCCUGGCUUCCGCAA-3'     (SEQ ID NO: 2898)
                  3'-CCGGUUCCGGAACGGACCGAAGGCGUU-5'   (SEQ ID NO: 2088)

AR-3298 Target:   5'-GGCCAAGGCCTTGCCTGGCTTCCGCAA-3'   (SEQ ID NO: 2493)

5'-CAAGGCCUUGCCUGGCUUCCGCAAC-3'     (SEQ ID NO: 2899)
                  3'-CGGUUCCGGAACGGACCGAAGGCGUUG-5'   (SEQ ID NO: 2089)

AR-3299 Target:   5'-GCCAAGGCCTTGCCTGGCTTCCGCAAC-3'   (SEQ ID NO: 2494)

5'-AAGGCCUUGCCUGGCUUCCGCAACU-3'     (SEQ ID NO: 2900)
                  3'-GGUUCCGGAACGGACCGAAGGCGUUGA-5'   (SEQ ID NO: 2090)

AR-3300 Target:   5'-CCAAGGCCTTGCCTGGCTTCCGCAACT-3'   (SEQ ID NO: 2495)

5'-AGGCCUUGCCUGGCUUCCGCAACUU-3'     (SEQ ID NO: 2901)
                  3'-GUUCCGGAACGGACCGAAGGCGUUGAA-5'   (SEQ ID NO: 2091)

AR-3301 Target:   5'-CAAGGCCTTGCCTGGCTTCCGCAACTT-3'   (SEQ ID NO: 2496)

5'-GGCCUUGCCUGGCUUCCGCAACUUA-3'     (SEQ ID NO: 2902)
                  3'-UUCCGGAACGGACCGAAGGCGUUGAAU-5'   (SEQ ID NO: 2092)

AR-3302 Target:   5'-AAGGCCTTGCCTGGCTTCCGCAACTTA-3'   (SEQ ID NO: 2497)

5'-GCCUUGCCUGGCUUCCGCAACUUAC-3'     (SEQ ID NO: 2903)
                  3'-UCCGGAACGGACCGAAGGCGUUGAAUG-5'   (SEQ ID NO: 2093)

AR-3303 Target:   5'-AGGCCTTGCCTGGCTTCCGCAACTTAC-3'   (SEQ ID NO: 2498)

5'-CCUUGCCUGGCUUCCGCAACUUACA-3'     (SEQ ID NO: 2904)
                  3'-CCGGAACGGACCGAAGGCGUUGAAUGU-5'   (SEQ ID NO: 2094)

AR-3304 Target:   5'-GGCCTTGCCTGGCTTCCGCAACTTACA-3'   (SEQ ID NO: 2499)

5'-CUUGCCUGGCUUCCGCAACUUACAC-3'     (SEQ ID NO: 2905)
                  3'-CGGAACGGACCGAAGGCGUUGAAUGUG-5'   (SEQ ID NO: 2095)

AR-3305 Target:   5'-GCCTTGCCTGGCTTCCGCAACTTACAC-3'   (SEQ ID NO: 2500)

5'-UUGCCUGGCUUCCGCAACUUACACG-3'     (SEQ ID NO: 2906)
                  3'-GGAACGGACCGAAGGCGUUGAAUGUGC-5'   (SEQ ID NO: 2096)

AR-3306 Target:   5'-CCTTGCCTGGCTTCCGCAACTTACACG-3'   (SEQ ID NO: 2501)

5'-UGCCUGGCUUCCGCAACUUACACGU-3'     (SEQ ID NO: 2907)
                  3'-GAACGGACCGAAGGCGUUGAAUGUGCA-5'   (SEQ ID NO: 2097)

AR-3307 Target:   5'-CTTGCCTGGCTTCCGCAACTTACACGT-3'   (SEQ ID NO: 2502)

5'-AAUGUCAACUCCAGGAUGCUCUACU-3'     (SEQ ID NO: 2908)
                  3'-GGUUACAGUUGAGGUCCUACGAGAUGA-5'   (SEQ ID NO: 2098)

AR-3408 Target:   5'-CCAATGTCAACTCCAGGATGCTCTACT-3'   (SEQ ID NO: 2503)

5'-AUGUCAACUCCAGGAUGCUCUACUU-3'     (SEQ ID NO: 2909)
                  3'-GUUACAGUUGAGGUCCUACGAGAUGAA-5'   (SEQ ID NO: 2099)

AR-3409 Target:   5'-CAATGTCAACTCCAGGATGCTCTACTT-3'   (SEQ ID NO: 2504)

5'-UGUCAACUCCAGGAUGCUCUACUUC-3'     (SEQ ID NO: 2910)
                  3'-UUACAGUUGAGGUCCUACGAGAUGAAG-5'   (SEQ ID NO: 2100)

AR-3410 Target:   5'-AATGTCAACTCCAGGATGCTCTACTTC-3'   (SEQ ID NO: 2505)

5'-GUCAACUCCAGGAUGCUCUACUUCG-3'     (SEQ ID NO: 2911)
                  3'-UACAGUUGAGGUCCUACGAGAUGAAGC-5'   (SEQ ID NO: 2101)

AR-3411 Target:   5'-ATGTCAACTCCAGGATGCTCTACTTCG-3'   (SEQ ID NO: 2506)

5'-UCAACUCCAGGAUGCUCUACUUCGC-3'     (SEQ ID NO: 2912)
                  3'-ACAGUUGAGGUCCUACGAGAUGAAGCG-5'   (SEQ ID NO: 2102)
```

TABLE 11-continued

AR Duplexes, Unmodified forms of Tested Duplexes, Human

```
AR-3412 Target:  5'-TGTCAACTCCAGGATGCTCTACTTCGC-3'      (SEQ ID NO: 2507)

5'-CAACUCCAGGAUGCUCUACUUCGCC-3'        (SEQ ID NO: 2913)
                 3'-CAGUUGAGGUCCUACGAGAUGAAGCGG-5'      (SEQ ID NO: 2103)

AR-3413 Target:  5'-GTCAACTCCAGGATGCTCTACTTCGCC-3'      (SEQ ID NO: 2508)

5'-AACUCCAGGAUGCUCUACUUCGCCC-3'        (SEQ ID NO: 2914)
                 3'-AGUUGAGGUCCUACGAGAUGAAGCGGG-5'      (SEQ ID NO: 2104)

AR-3414 Target:  5'-TCAACTCCAGGATGCTCTACTTCGCCC-3'      (SEQ ID NO: 2509)

5'-UGGUUUUCAAUGAGUACCGCAUGCA-3'        (SEQ ID NO: 2915)
                 3'-AGACCAAAAGUUACUCAUGGCGUACGU-5'      (SEQ ID NO: 2105)

AR-3445 Target:  5'-TCTGGTTTTCAATGAGTACCGCATGCA-3'      (SEQ ID NO: 2510)

5'-GGUUUUCAAUGAGUACCGCAUGCAC-3'        (SEQ ID NO: 2916)
                 3'-GACCAAAAGUUACUCAUGGCGUACGUG-5'      (SEQ ID NO: 2106)

AR-3446 Target:  5'-CTGGTTTTCAATGAGTACCGCATGCAC-3'      (SEQ ID NO: 2511)

5'-GUUUUCAAUGAGUACCGCAUGCACA-3'        (SEQ ID NO: 2917)
                 3'-ACCAAAAGUUACUCAUGGCGUACGUGU-5'      (SEQ ID NO: 2107)

AR-3447 Target:  5'-TGGTTTTCAATGAGTACCGCATGCACA-3'      (SEQ ID NO: 2512)

5'-UUUUCAAUGAGUACCGCAUGCACAA-3'        (SEQ ID NO: 2918)
                 3'-CCAAAAGUUACUCAUGGCGUACGUGUU-5'      (SEQ ID NO: 2108)

AR-3448 Target:  5'-GGTTTTCAATGAGTACCGCATGCACAA-3'      (SEQ ID NO: 2513)

5'-UUUCAAUGAGUACCGCAUGCACAAG-3'        (SEQ ID NO: 2919)
                 3'-CAAAAGUUACUCAUGGCGUACGUGUUC-5'      (SEQ ID NO: 2109)

AR-3449 Target:  5'-GTTTTCAATGAGTACCGCATGCACAAG-3'      (SEQ ID NO: 2514)

5'-UUCAAUGAGUACCGCAUGCACAAGU-3'        (SEQ ID NO: 2920)
                 3'-AAAAGUUACUCAUGGCGUACGUGUUCA-5'      (SEQ ID NO: 2110)

AR-3450 Target:  5'-TTTTCAATGAGTACCGCATGCACAAGT-3'      (SEQ ID NO: 2515)

5'-UCAAUGAGUACCGCAUGCACAAGUC-3'        (SEQ ID NO: 2921)
                 3'-AAAGUUACUCAUGGCGUACGUGUUCAG-5'      (SEQ ID NO: 2111)

AR-3451 Target:  5'-TTTCAATGAGTACCGCATGCACAAGTC-3'      (SEQ ID NO: 2516)

5'-CAAUGAGUACCGCAUGCACAAGUCC-3'        (SEQ ID NO: 2922)
                 3'-AAGUUACUCAUGGCGUACGUGUUCAGG-5'      (SEQ ID NO: 2112)

AR-3452 Target:  5'-TTCAATGAGTACCGCATGCACAAGTCC-3'      (SEQ ID NO: 2517)

5'-AAUGAGUACCGCAUGCACAAGUCCC-3'        (SEQ ID NO: 2923)
                 3'-AGUUACUCAUGGCGUACGUGUUCAGGG-5'      (SEQ ID NO: 2113)

AR-3453 Target:  5'-TCAATGAGTACCGCATGCACAAGTCCC-3'      (SEQ ID NO: 2518)

5'-AUGAGUACCGCAUGCACAAGUCCCG-3'        (SEQ ID NO: 2924)
                 3'-GUUACUCAUGGCGUACGUGUUCAGGGC-5'      (SEQ ID NO: 2114)

AR-3454 Target:  5'-CAATGAGTACCGCATGCACAAGTCCCG-3'      (SEQ ID NO: 2519)

5'-UGAGUACCGCAUGCACAAGUCCCGG-3'        (SEQ ID NO: 2925)
                 3'-UUACUCAUGGCGUACGUGUUCAGGGCC-5'      (SEQ ID NO: 2115)

AR-3455 Target:  5'-AATGAGTACCGCATGCACAAGTCCCGG-3'      (SEQ ID NO: 2520)

5'-GAGUACCGCAUGCACAAGUCCCGGA-3'        (SEQ ID NO: 2926)
                 3'-UACUCAUGGCGUACGUGUUCAGGGCCU-5'      (SEQ ID NO: 2116)

AR-3456 Target:  5'-ATGAGTACCGCATGCACAAGTCCCGGA-3'      (SEQ ID NO: 2521)

5'-AGUACCGCAUGCACAAGUCCCGGAU-3'        (SEQ ID NO: 2927)
                 3'-ACUCAUGGCGUACGUGUUCAGGGCCUA-5'      (SEQ ID NO: 2117)
```

TABLE 11-continued

AR Duplexes, Unmodified forms of Tested Duplexes, Human

```
AR-3457 Target:   5'-TGAGTACCGCATGCACAAGTCCCGGAT-3'   (SEQ ID NO: 2522)

5'-UCUCAAGAGUUUGGAUGGCUCCAAA-3'     (SEQ ID NO: 2928)
                  3'-AGAGAGUUCUCAAACCUACCGAGGUUU-5'   (SEQ ID NO: 2118)

AR-3513 Target:   5'-TCTCTCAAGAGTTTGGATGGCTCCAAA-3'   (SEQ ID NO: 2523)

5'-CUCAAGAGUUUGGAUGGCUCCAAAU-3'    (SEQ ID NO: 2929)
                  3'-GAGAGUUCUCAAACCUACCGAGGUUUA-5'   (SEQ ID NO: 2119)

AR-3514 Target:   5'-CTCTCAAGAGTTTGGATGGCTCCAAAT-3'   (SEQ ID NO: 2524)

5'-UCAAGAGUUUGGAUGGCUCCAAAUC-3'    (SEQ ID NO: 2930)
                  3'-AGAGUUCUCAAACCUACCGAGGUUUAG-5'   (SEQ ID NO: 2120)

AR-3515 Target:   5'-TCTCAAGAGTTTGGATGGCTCCAAATC-3'   (SEQ ID NO: 2525)

5'-CAAGAGUUUGGAUGGCUCCAAAUCA-3'    (SEQ ID NO: 2931)
                  3'-GAGUUCUCAAACCUACCGAGGUUUAGU-5'   (SEQ ID NO: 2121)

AR-3516 Target:   5'-CTCAAGAGTTTGGATGGCTCCAAATCA-3'   (SEQ ID NO: 2526)

5'-AAGAGUUUGGAUGGCUCCAAAUCAC-3'    (SEQ ID NO: 2932)
                  3'-AGUUCUCAAACCUACCGAGGUUUAGUG-5'   (SEQ ID NO: 2122)

AR-3517 Target:   5'-TCAAGAGTTTGGATGGCTCCAAATCAC-3'   (SEQ ID NO: 2527)

5'-AGAGUUUGGAUGGCUCCAAAUCACC-3'    (SEQ ID NO: 2933)
                  3'-GUUCUCAAACCUACCGAGGUUUAGUGG-5'   (SEQ ID NO: 2123)

AR-3518 Target:   5'-CAAGAGTTTGGATGGCTCCAAATCACC-3'   (SEQ ID NO: 2528)

5'-GAGUUUGGAUGGCUCCAAAUCACCC-3'    (SEQ ID NO: 2934)
                  3'-UUCUCAAACCUACCGAGGUUUAGUGGG-5'   (SEQ ID NO: 2124)

AR-3519 Target:   5'-AAGAGTTTGGATGGCTCCAAATCACCC-3'   (SEQ ID NO: 2529)

5'-CAGGAAUUCCUGUGCAUGAAAGCAC-3'    (SEQ ID NO: 2935)
                  3'-GGGUCCUUAAGGACACGUACUUUCGUG-5'   (SEQ ID NO: 2125)

AR-3546 Target:   5'-CCCAGGAATTCCTGTGCATGAAAGCAC-3'   (SEQ ID NO: 2530)

5'-AGGAAUUCCUGUGCAUGAAAGCACU-3'    (SEQ ID NO: 2936)
                  3'-GGUCCUUAAGGACACGUACUUUCGUGA-5'   (SEQ ID NO: 2126)

AR-3547 Target:   5'-CCAGGAATTCCTGTGCATGAAAGCACT-3'   (SEQ ID NO: 2531)

5'-GGAAUUCCUGUGCAUGAAAGCACUG-3'    (SEQ ID NO: 2937)
                  3'-GUCCUUAAGGACACGUACUUUCGUGAC-5'   (SEQ ID NO: 2127)

AR-3548 Target:   5'-CAGGAATTCCTGTGCATGAAAGCACTG-3'   (SEQ ID NO: 2532)

5'-GAAUUCCUGUGCAUGAAAGCACUGC-3'    (SEQ ID NO: 2938)
                  3'-UCCUUAAGGACACGUACUUUCGUGACG-5'   (SEQ ID NO: 2128)

AR-3549 Target:   5'-AGGAATTCCTGTGCATGAAAGCACTGC-3'   (SEQ ID NO: 2533)

5'-AAUUCCUGUGCAUGAAAGCACUGCU-3'    (SEQ ID NO: 2939)
                  3'-CCUUAAGGACACGUACUUUCGUGACGA-5'   (SEQ ID NO: 2129)

AR-3550 Target:   5'-GGAATTCCTGTGCATGAAAGCACTGCT-3'   (SEQ ID NO: 2534)

5'-AUUCCUGUGCAUGAAAGCACUGCUA-3'    (SEQ ID NO: 2940)
                  3'-CUUAAGGACACGUACUUUCGUGACGAU-5'   (SEQ ID NO: 2130)

AR-3551 Target:   5'-GAATTCCTGTGCATGAAAGCACTGCTA-3'   (SEQ ID NO: 2535)

5'-UUCCUGUGCAUGAAAGCACUGCUAC-3'    (SEQ ID NO: 2941)
                  3'-UUAAGGACACGUACUUUCGUGACGAUG-5'   (SEQ ID NO: 2131)

AR-3552 Target:   5'-AATTCCTGTGCATGAAAGCACTGCTAC-3'   (SEQ ID NO: 2536)

5'-UCCUGUGCAUGAAAGCACUGCUACU-3'    (SEQ ID NO: 2942)
                  3'-UAAGGACACGUACUUUCGUGACGAUGA-5'   (SEQ ID NO: 2132)
```

TABLE 11-continued

AR Duplexes, Unmodified forms of Tested Duplexes, Human

```
AR-3553 Target:  5'-ATTCCTGTGCATGAAAGCACTGCTACT-3'    (SEQ ID NO: 2537)

5'-CCUGUGCAUGAAAGCACUGCUACUC-3'      (SEQ ID NO: 2943)
                 3'-AAGGACACGUACUUUCGUGACGAUGAG-5'    (SEQ ID NO: 2133)

AR-3554 Target:  5'-TTCCTGTGCATGAAAGCACTGCTACTC-3'    (SEQ ID NO: 2538)

5'-CUGUGCAUGAAAGCACUGCUACUCU-3'      (SEQ ID NO: 2944)
                 3'-AGGACACGUACUUUCGUGACGAUGAGA-5'    (SEQ ID NO: 2134)

AR-3555 Target:  5'-TCCTGTGCATGAAAGCACTGCTACTCT-3'    (SEQ ID NO: 2539)

5'-UGUGCAUGAAAGCACUGCUACUCUU-3'      (SEQ ID NO: 2945)
                 3'-GGACACGUACUUUCGUGACGAUGAGAA-5'    (SEQ ID NO: 2135)

AR-3556 Target:  5'-CCTGTGCATGAAAGCACTGCTACTCTT-3'    (SEQ ID NO: 2540)

5'-CUCUUCAGCAUUAUUCCAGUGGAUG-3'      (SEQ ID NO: 2946)
                 3'-AUGAGAAGUCGUAAUAAGGUCACCUAC-5'    (SEQ ID NO: 2136)

AR-3576 Target:  5'-TACTCTTCAGCATTATTCCAGTGGATG-3'    (SEQ ID NO: 2541)

5'-UCUUCAGCAUUAUUCCAGUGGAUGG-3'      (SEQ ID NO: 2947)
                 3'-UGAGAAGUCGUAAUAAGGUCACCUACC-5'    (SEQ ID NO: 2137)

AR-3577 Target:  5'-ACTCTTCAGCATTATTCCAGTGGATGG-3'    (SEQ ID NO: 2542)

5'-CUUCAGCAUUAUUCCAGUGGAUGGG-3'      (SEQ ID NO: 2948)
                 3'-GAGAAGUCGUAAUAAGGUCACCUACCC-5'    (SEQ ID NO: 2138)

AR-3578 Target:  5'-CTCTTCAGCATTATTCCAGTGGATGGG-3'    (SEQ ID NO: 2543)

5'-UUCAGCAUUAUUCCAGUGGAUGGGC-3'      (SEQ ID NO: 2949)
                 3'-AGAAGUCGUAAUAAGGUCACCUACCCG-5'    (SEQ ID NO: 2139)

AR-3579 Target:  5'-TCTTCAGCATTATTCCAGTGGATGGGC-3'    (SEQ ID NO: 2544)

5'-UCAGCAUUAUUCCAGUGGAUGGGCU-3'      (SEQ ID NO: 2950)
                 3'-GAAGUCGUAAUAAGGUCACCUACCCGA-5'    (SEQ ID NO: 2140)

AR-3580 Target:  5'-CTTCAGCATTATTCCAGTGGATGGGCT-3'    (SEQ ID NO: 2545)

5'-CAGCAUUAUUCCAGUGGAUGGGCUG-3'      (SEQ ID NO: 2951)
                 3'-AAGUCGUAAUAAGGUCACCUACCCGAC-5'    (SEQ ID NO: 2141)

AR-3581 Target:  5'-TTCAGCATTATTCCAGTGGATGGGCTG-3'    (SEQ ID NO: 2546)

5'-AGCAUUAUUCCAGUGGAUGGGCUGA-3'      (SEQ ID NO: 2952)
                 3'-AGUCGUAAUAAGGUCACCUACCCGACU-5'    (SEQ ID NO: 2142)

AR-3582 Target:  5'-TCAGCATTATTCCAGTGGATGGGCTGA-3'    (SEQ ID NO: 2547)

5'-GCAUUAUUCCAGUGGAUGGGCUGAA-3'      (SEQ ID NO: 2953)
                 3'-GUCGUAAUAAGGUCACCUACCCGACUU-5'    (SEQ ID NO: 2143)

AR-3583 Target:  5'-CAGCATTATTCCAGTGGATGGGCTGAA-3'    (SEQ ID NO: 2548)

5'-CAUUAUUCCAGUGGAUGGGCUGAAA-3'      (SEQ ID NO: 2954)
                 3'-UCGUAAUAAGGUCACCUACCCGACUUU-5'    (SEQ ID NO: 2144)

AR-3584 Target:  5'-AGCATTATTCCAGTGGATGGGCTGAAA-3'    (SEQ ID NO: 2549)

5'-AUUAUUCCAGUGGAUGGGCUGAAAA-3'      (SEQ ID NO: 2955)
                 3'-CGUAAUAAGGUCACCUACCCGACUUUU-5'    (SEQ ID NO: 2145)

AR-3585 Target:  5'-GCATTATTCCAGTGGATGGGCTGAAAA-3'    (SEQ ID NO: 2550)

5'-UUAUUCCAGUGGAUGGGCUGAAAAA-3'      (SEQ ID NO: 2956)
                 3'-GUAAUAAGGUCACCUACCCGACUUUUU-5'    (SEQ ID NO: 2146)

AR-3586 Target:  5'-CATTATTCCAGTGGATGGGCTGAAAAA-3'    (SEQ ID NO: 2551)

5'-UAUUCCAGUGGAUGGGCUGAAAAAU-3'      (SEQ ID NO: 2957)
                 3'-UAAUAAGGUCACCUACCCGACUUUUUA-5'    (SEQ ID NO: 2147)
```

TABLE 11-continued

AR Duplexes, Unmodified forms of Tested Duplexes, Human

```
AR-3587 Target:  5'-ATTATTCCAGTGGATGGGCTGAAAAAT-3'   (SEQ ID NO: 2552)

5'-AUUCCAGUGGAUGGGCUGAAAAAUC-3'     (SEQ ID NO: 2958)
                 3'-AAUAAGGUCACCUACCCGACUUUUUAG-5'   (SEQ ID NO: 2148)

AR-3588 Target:  5'-TTATTCCAGTGGATGGGCTGAAAAATC-3'   (SEQ ID NO: 2553)

5'-UUCCAGUGGAUGGGCUGAAAAAUCA-3'    (SEQ ID NO: 2959)
                 3'-AUAAGGUCACCUACCCGACUUUUUAGU-5'  (SEQ ID NO: 2149)

AR-3589 Target:  5'-TATTCCAGTGGATGGGCTGAAAAATCA-3'   (SEQ ID NO: 2554)

5'-UCCAGUGGAUGGGCUGAAAAAUCAA-3'    (SEQ ID NO: 2960)
                 3'-UAAGGUCACCUACCCGACUUUUUAGUU-5'  (SEQ ID NO: 2150)

AR-3590 Target:  5'-ATTCCAGTGGATGGGCTGAAAAATCAA-3'   (SEQ ID NO: 2555)

5'-CCAGUGGAUGGGCUGAAAAAUCAAA-3'    (SEQ ID NO: 2961)
                 3'-AAGGUCACCUACCCGACUUUUUAGUUU-5'  (SEQ ID NO: 2151)

AR-3591 Target:  5'-TTCCAGTGGATGGGCTGAAAAATCAAA-3'   (SEQ ID NO: 2556)

5'-CAGUGGAUGGGCUGAAAAAUCAAAA-3'    (SEQ ID NO: 2962)
                 3'-AGGUCACCUACCCGACUUUUUAGUUUU-5'  (SEQ ID NO: 2152)

AR-3592 Target:  5'-TCCAGTGGATGGGCTGAAAAATCAAAA-3'   (SEQ ID NO: 2557)

5'-AGUGGAUGGGCUGAAAAAUCAAAAA-3'    (SEQ ID NO: 2963)
                 3'-GGUCACCUACCCGACUUUUUAGUUUUU-5'  (SEQ ID NO: 2153)

AR-3593 Target:  5'-CCAGTGGATGGGCTGAAAAATCAAAAA-3'   (SEQ ID NO: 2558)

5'-GUGGAUGGGCUGAAAAAUCAAAAAU-3'    (SEQ ID NO: 2964)
                 3'-GUCACCUACCCGACUUUUUAGUUUUUA-5'  (SEQ ID NO: 2154)

AR-3594 Target:  5'-CAGTGGATGGGCTGAAAAATCAAAAAT-3'   (SEQ ID NO: 2559)

5'-UGGAUGGGCUGAAAAAUCAAAAAUU-3'    (SEQ ID NO: 2965)
                 3'-UCACCUACCCGACUUUUUAGUUUUUAA-5'  (SEQ ID NO: 2155)

AR-3595 Target:  5'-AGTGGATGGGCTGAAAAATCAAAAATT-3'   (SEQ ID NO: 2560)

5'-GGAUGGGCUGAAAAAUCAAAAAUUC-3'    (SEQ ID NO: 2966)
                 3'-CACCUACCCGACUUUUUAGUUUUUAAG-5'  (SEQ ID NO: 2156)

AR-3596 Target:  5'-GTGGATGGGCTGAAAAATCAAAAATTC-3'   (SEQ ID NO: 2561)

5'-GAUGGGCUGAAAAAUCAAAAAUUCU-3'    (SEQ ID NO: 2967)
                 3'-ACCUACCCGACUUUUUAGUUUUUAAGA-5'  (SEQ ID NO: 2157)

AR-3597 Target:  5'-TGGATGGGCTGAAAAATCAAAAATTCT-3'   (SEQ ID NO: 2562)

5'-AUGGGCUGAAAAAUCAAAAAUUCUU-3'    (SEQ ID NO: 2968)
                 3'-CCUACCCGACUUUUUAGUUUUUAAGAA-5'  (SEQ ID NO: 2158)

AR-3598 Target:  5'-GGATGGGCTGAAAAATCAAAAATTCTT-3'   (SEQ ID NO: 2563)

5'-UGGGCUGAAAAAUCAAAAAUUCUUU-3'    (SEQ ID NO: 2969)
                 3'-CUACCCGACUUUUUAGUUUUUAAGAAA-5'  (SEQ ID NO: 2159)

AR-3599 Target:  5'-GATGGGCTGAAAAATCAAAAATTCTTT-3'   (SEQ ID NO: 2564)

5'-GGGCUGAAAAAUCAAAAAUUCUUUG-3'    (SEQ ID NO: 2970)
                 3'-UACCCGACUUUUUAGUUUUUAAGAAAC-5'  (SEQ ID NO: 2160)

AR-3600 Target:  5'-ATGGGCTGAAAAATCAAAAATTCTTTG-3'   (SEQ ID NO: 2565)

5'-GGCUGAAAAAUCAAAAAUUCUUUGA-3'    (SEQ ID NO: 2971)
                 3'-ACCCGACUUUUUAGUUUUUAAGAAACU-5'  (SEQ ID NO: 2161)

AR-3601 Target:  5'-TGGGCTGAAAAATCAAAAATTCTTTGA-3'   (SEQ ID NO: 2566)

5'-GCUGAAAAAUCAAAAAUUCUUUGAU-3'    (SEQ ID NO: 2972)
                 3'-CCCGACUUUUUAGUUUUUAAGAAACUA-5'  (SEQ ID NO: 2162)
```

TABLE 11-continued

AR Duplexes, Unmodified forms of Tested Duplexes, Human

```
AR-3602 Target:  5'-GGGCTGAAAAATCAAAAATTCTTTGAT-3'   (SEQ ID NO: 2567)

5'-CUGAAAAAUCAAAAAUUCUUUGAUG-3'    (SEQ ID NO: 2973)
                 3'-CCGACUUUUUAGUUUUUAAGAAACUAC-5'  (SEQ ID NO: 2163)

AR-3603 Target:  5'-GGCTGAAAAATCAAAAATTCTTTGATG-3'   (SEQ ID NO: 2568)

5'-UGAAAAAUCAAAAAUUCUUUGAUGA-3'    (SEQ ID NO: 2974)
                 3'-CGACUUUUUAGUUUUUAAGAAACUACU-5'  (SEQ ID NO: 2164)

AR-3604 Target:  5'-GCTGAAAAATCAAAAATTCTTTGATGA-3'   (SEQ ID NO: 2569)

5'-GAAAAAUCAAAAAUUCUUUGAUGAA-3'    (SEQ ID NO: 2975)
                 3'-GACUUUUUAGUUUUUAAGAAACUACUU-5'  (SEQ ID NO: 2165)

AR-3605 Target:  5'-CTGAAAAATCAAAAATTCTTTGATGAA-3'   (SEQ ID NO: 2570)

5'-AAAAAUCAAAAAUUCUUUGAUGAAC-3'    (SEQ ID NO: 2976)
                 3'-ACUUUUUAGUUUUUAAGAAACUACUUG-5'  (SEQ ID NO: 2166)

AR-3606 Target:  5'-TGAAAAATCAAAAATTCTTTGATGAAC-3'   (SEQ ID NO: 2571)

5'-AAAUCAAAAAUUCUUUGAUGAACUU-3'    (SEQ ID NO: 2977)
                 3'-UUUUUAGUUUUUAAGAAACUACUUGAA-5'  (SEQ ID NO: 2167)

AR-3608 Target:  5'-AAAAATCAAAAATTCTTTGATGAACTT-3'   (SEQ ID NO: 2572)

5'-AAUCAAAAAUUCUUUGAUGAACUUC-3'    (SEQ ID NO: 2978)
                 3'-UUUUAGUUUUUAAGAAACUACUUGAAG-5'  (SEQ ID NO: 2168)

AR-3609 Target:  5'-AAAATCAAAAATTCTTTGATGAACTTC-3'   (SEQ ID NO: 2573)

5'-AUCAAAAAUUCUUUGAUGAACUUCG-3'    (SEQ ID NO: 2979)
                 3'-UUUAGUUUUUAAGAAACUACUUGAAGC-5'  (SEQ ID NO: 2169)

AR-3610 Target:  5'-AAATCAAAAATTCTTTGATGAACTTCG-3'   (SEQ ID NO: 2574)

5'-UCAAAAAUUCUUUGAUGAACUUCGA-3'    (SEQ ID NO: 2980)
                 3'-UUAGUUUUUAAGAAACUACUUGAAGCU-5'  (SEQ ID NO: 2170)

AR-3611 Target:  5'-AATCAAAAATTCTTTGATGAACTTCGA-3'   (SEQ ID NO: 2575)

5'-CAAAAAUUCUUUGAUGAACUUCGAA-3'    (SEQ ID NO: 2981)
                 3'-UAGUUUUUAAGAAACUACUUGAAGCUU-5'  (SEQ ID NO: 2171)

AR-3612 Target:  5'-ATCAAAAATTCTTTGATGAACTTCGAA-3'   (SEQ ID NO: 2576)

5'-AAAAAUUCUUUGAUGAACUUCGAAU-3'    (SEQ ID NO: 2982)
                 3'-AGUUUUUAAGAAACUACUUGAAGCUUA-5'  (SEQ ID NO: 2172)

AR-3613 Target:  5'-TCAAAAATTCTTTGATGAACTTCGAAT-3'   (SEQ ID NO: 2577)

5'-AAAAUUCUUUGAUGAACUUCGAAUG-3'    (SEQ ID NO: 2983)
                 3'-GUUUUUAAGAAACUACUUGAAGCUUAC-5'  (SEQ ID NO: 2173)

AR-3614 Target:  5'-CAAAAATTCTTTGATGAACTTCGAATG-3'   (SEQ ID NO: 2578)

5'-AAAUUCUUUGAUGAACUUCGAAUGA-3'    (SEQ ID NO: 2984)
                 3'-UUUUUAAGAAACUACUUGAAGCUUACU-5'  (SEQ ID NO: 2174)

AR-3615 Target:  5'-AAAAATTCTTTGATGAACTTCGAATGA-3'   (SEQ ID NO: 2579)

5'-AAUUCUUUGAUGAACUUCGAAUGAA-3'    (SEQ ID NO: 2985)
                 3'-UUUUAAGAAACUACUUGAAGCUUACUU-5'  (SEQ ID NO: 2175)

AR-3616 Target:  5'-AAAATTCTTTGATGAACTTCGAATGAA-3'   (SEQ ID NO: 2580)

5'-AUUCUUUGAUGAACUUCGAAUGAAC-3'    (SEQ ID NO: 2986)
                 3'-UUUAAGAAACUACUUGAAGCUUACUUG-5'  (SEQ ID NO: 2176)

AR-3617 Target:  5'-AAATTCTTTGATGAACTTCGAATGAAC-3'   (SEQ ID NO: 2581)

5'-UUCUUUGAUGAACUUCGAAUGAACU-3'    (SEQ ID NO: 2987)
                 3'-UUAAGAAACUACUUGAAGCUUACUUGA-5'  (SEQ ID NO: 2177)
```

TABLE 11-continued

AR Duplexes, Unmodified forms of Tested Duplexes, Human

```
AR-3618 Target:  5'-AATTCTTTGATGAACTTCGAATGAACT-3'    (SEQ ID NO: 2582)

5'-UCUUUGAUGAACUUCGAAUGAACUA-3'      (SEQ ID NO: 2988)
                 3'-UAAGAAACUACUUGAAGCUUACUUGAU-5'    (SEQ ID NO: 2178)

AR-3619 Target:  5'-ATTCTTTGATGAACTTCGAATGAACTA-3'    (SEQ ID NO: 2583)

5'-CUUUGAUGAACUUCGAAUGAACUAC-3'      (SEQ ID NO: 2989)
                 3'-AAGAAACUACUUGAAGCUUACUUGAUG-5'    (SEQ ID NO: 2179)

AR-3620 Target:  5'-TTCTTTGATGAACTTCGAATGAACTAC-3'    (SEQ ID NO: 2584)

5'-UUUGAUGAACUUCGAAUGAACUACA-3'      (SEQ ID NO: 2990)
                 3'-AGAAACUACUUGAAGCUUACUUGAUGU-5'    (SEQ ID NO: 2180)

AR-3621 Target:  5'-TCTTTGATGAACTTCGAATGAACTACA-3'    (SEQ ID NO: 2585)

5'-UUGAUGAACUUCGAAUGAACUACAU-3'      (SEQ ID NO: 2991)
                 3'-GAAACUACUUGAAGCUUACUUGAUGUA-5'    (SEQ ID NO: 2181)

AR-3622 Target:  5'-CTTTGATGAACTTCGAATGAACTACAT-3'    (SEQ ID NO: 2586)

5'-UGAUGAACUUCGAAUGAACUACAUC-3'      (SEQ ID NO: 2992)
                 3'-AAACUACUUGAAGCUUACUUGAUGUAG-5'    (SEQ ID NO: 2182)

AR-3623 Target:  5'-TTTGATGAACTTCGAATGAACTACATC-3'    (SEQ ID NO: 2587)

5'-GAUGAACUUCGAAUGAACUACAUCA-3'      (SEQ ID NO: 2993)
                 3'-AACUACUUGAAGCUUACUUGAUGUAGU-5'    (SEQ ID NO: 2183)

AR-3624 Target:  5'-TTGATGAACTTCGAATGAACTACATCA-3'    (SEQ ID NO: 2588)

5'-AUGAACUUCGAAUGAACUACAUCAA-3'      (SEQ ID NO: 2994)
                 3'-ACUACUUGAAGCUUACUUGAUGUAGUU-5'    (SEQ ID NO: 2184)

AR-3625 Target:  5'-TGATGAACTTCGAATGAACTACATCAA-3'    (SEQ ID NO: 2589)

5'-UGAACUUCGAAUGAACUACAUCAAG-3'      (SEQ ID NO: 2995)
                 3'-CUACUUGAAGCUUACUUGAUGUAGUUC-5'    (SEQ ID NO: 2185)

AR-3626 Target:  5'-GATGAACTTCGAATGAACTACATCAAG-3'    (SEQ ID NO: 2590)

5'-GAACUUCGAAUGAACUACAUCAAGG-3'      (SEQ ID NO: 2996)
                 3'-UACUUGAAGCUUACUUGAUGUAGUUCC-5'    (SEQ ID NO: 2186)

AR-3627 Target:  5'-ATGAACTTCGAATGAACTACATCAAGG-3'    (SEQ ID NO: 2591)

5'-AACUUCGAAUGAACUACAUCAAGGA-3'      (SEQ ID NO: 2997)
                 3'-ACUUGAAGCUUACUUGAUGUAGUUCCU-5'    (SEQ ID NO: 2187)

AR-3628 Target:  5'-TGAACTTCGAATGAACTACATCAAGGA-3'    (SEQ ID NO: 2592)

5'-ACUUCGAAUGAACUACAUCAAGGAA-3'      (SEQ ID NO: 2998)
                 3'-CUUGAAGCUUACUUGAUGUAGUUCCUU-5'    (SEQ ID NO: 2188)

AR-3629 Target:  5'-GAACTTCGAATGAACTACATCAAGGAA-3'    (SEQ ID NO: 2593)

5'-CUUCGAAUGAACUACAUCAAGGAAC-3'      (SEQ ID NO: 2999)
                 3'-UUGAAGCUUACUUGAUGUAGUUCCUUG-5'    (SEQ ID NO: 2189)

AR-3630 Target:  5'-AACTTCGAATGAACTACATCAAGGAAC-3'    (SEQ ID NO: 2594)

5'-UUCGAAUGAACUACAUCAAGGAACU-3'      (SEQ ID NO: 3000)
                 3'-UGAAGCUUACUUGAUGUAGUUCCUUGA-5'    (SEQ ID NO: 2190)

AR-3631 Target:  5'-ACTTCGAATGAACTACATCAAGGAACT-3'    (SEQ ID NO: 2595)

5'-UCGAAUGAACUACAUCAAGGAACUC-3'      (SEQ ID NO: 3001)
                 3'-GAAGCUUACUUGAUGUAGUUCCUUGAG-5'    (SEQ ID NO: 2191)

AR-3632 Target:  5'-CTTCGAATGAACTACATCAAGGAACTC-3'    (SEQ ID NO: 2596)

5'-CGAAUGAACUACAUCAAGGAACUCG-3'      (SEQ ID NO: 3002)
                 3'-AAGCUUACUUGAUGUAGUUCCUUGAGC-5'    (SEQ ID NO: 2192)
```

TABLE 11-continued

AR Duplexes, Unmodified forms of Tested Duplexes, Human

```
AR-3633 Target:  5'-TTCGAATGAACTACATCAAGGAACTCG-3'   (SEQ ID NO: 2597)

5'-GAAUGAACUACAUCAAGGAACUCGA-3'    (SEQ ID NO: 3003)
                 3'-AGCUUACUUGAUGUAGUUCCUUGAGCU-5'  (SEQ ID NO: 2193)

AR-3634 Target:  5'-TCGAATGAACTACATCAAGGAACTCGA-3'  (SEQ ID NO: 2598)

5'-AAUGAACUACAUCAAGGAACUCGAU-3'   (SEQ ID NO: 3004)
                 3'-GCUUACUUGAUGUAGUUCCUUGAGCUA-5' (SEQ ID NO: 2194)

AR-3635 Target:  5'-CGAATGAACTACATCAAGGAACTCGAT-3' (SEQ ID NO: 2599)

5'-AUGAACUACAUCAAGGAACUCGAUC-3'  (SEQ ID NO: 3005)
                 3'-CUUACUUGAUGUAGUUCCUUGAGCUAG-5' (SEQ ID NO: 2195)

AR-3636 Target:  5'-GAATGAACTACATCAAGGAACTCGATC-3' (SEQ ID NO: 2600)

5'-UGAACUACAUCAAGGAACUCGAUCG-3'  (SEQ ID NO: 3006)
                 3'-UUACUUGAUGUAGUUCCUUGAGCUAGC-5' (SEQ ID NO: 2196)

AR-3637 Target:  5'-AATGAACTACATCAAGGAACTCGATCG-3' (SEQ ID NO: 2601)

5'-GAACUACAUCAAGGAACUCGAUCGU-3'  (SEQ ID NO: 3007)
                 3'-UACUUGAUGUAGUUCCUUGAGCUAGCA-5' (SEQ ID NO: 2197)

AR-3638 Target:  5'-ATGAACTACATCAAGGAACTCGATCGT-3' (SEQ ID NO: 2602)

5'-AACUACAUCAAGGAACUCGAUCGUA-3'  (SEQ ID NO: 3008)
                 3'-ACUUGAUGUAGUUCCUUGAGCUAGCAU-5' (SEQ ID NO: 2198)

AR-3639 Target:  5'-TGAACTACATCAAGGAACTCGATCGTA-3' (SEQ ID NO: 2603)

5'-ACUACAUCAAGGAACUCGAUCGUAU-3'  (SEQ ID NO: 3009)
                 3'-CUUGAUGUAGUUCCUUGAGCUAGCAUA-5' (SEQ ID NO: 2199)

AR-3640 Target:  5'-GAACTACATCAAGGAACTCGATCGTAT-3' (SEQ ID NO: 2604)

5'-CUACAUCAAGGAACUCGAUCGUAUC-3'  (SEQ ID NO: 3010)
                 3'-UUGAUGUAGUUCCUUGAGCUAGCAUAG-5' (SEQ ID NO: 2200)

AR-3641 Target:  5'-AACTACATCAAGGAACTCGATCGTATC-3' (SEQ ID NO: 2605)

5'-UACAUCAAGGAACUCGAUCGUAUCA-3'  (SEQ ID NO: 3011)
                 3'-UGAUGUAGUUCCUUGAGCUAGCAUAGU-5' (SEQ ID NO: 2201)

AR-3642 Target:  5'-ACTACATCAAGGAACTCGATCGTATCA-3' (SEQ ID NO: 2606)

5'-ACAUCAAGGAACUCGAUCGUAUCAU-3'  (SEQ ID NO: 3012)
                 3'-GAUGUAGUUCCUUGAGCUAGCAUAGUA-5' (SEQ ID NO: 2202)

AR-3643 Target:  5'-CTACATCAAGGAACTCGATCGTATCAT-3' (SEQ ID NO: 2607)

5'-AUCAUUGCAUGCAAAAGAAAAAAUC-3'  (SEQ ID NO: 3013)
                 3'-CAUAGUAACGUACGUUUUCUUUUUUAG-5' (SEQ ID NO: 2203)

AR-3663 Target:  5'-GTATCATTGCATGCAAAAGAAAAAATC-3' (SEQ ID NO: 2608)

5'-UCAUUGCAUGCAAAAGAAAAAAUCC-3'  (SEQ ID NO: 3014)
                 3'-AUAGUAACGUACGUUUUCUUUUUUAGG-5' (SEQ ID NO: 2204)

AR-3664 Target:  5'-TATCATTGCATGCAAAAGAAAAAATCC-3' (SEQ ID NO: 2609)

5'-AAUCCCACAUCCUGCUCAAGACGCU-3'  (SEQ ID NO: 3015)
                 3'-UUUUAGGGUGUAGGACGAGUUCUGCGA-5' (SEQ ID NO: 2205)

AR-3684 Target:  5'-AAAATCCCACATCCTGCTCAAGACGCT-3' (SEQ ID NO: 2610)

5'-AUCCCACAUCCUGCUCAAGACGCUU-3'  (SEQ ID NO: 3016)
                 3'-UUUAGGGUGUAGGACGAGUUCUGCGAA-5' (SEQ ID NO: 2206)

AR-3685 Target:  5'-AAATCCCACATCCTGCTCAAGACGCTT-3' (SEQ ID NO: 2611)

5'-CGCUUCUACCAGCUCACCAAGCUCC-3'  (SEQ ID NO: 3017)
                 3'-CUGCGAAGAUGGUCGAGUGGUUCGAGG-5' (SEQ ID NO: 2207)
```

TABLE 11-continued

AR Duplexes, Unmodified forms of Tested Duplexes, Human

```
AR-3705 Target:  5'-GACGCTTCTACCAGCTCACCAAGCTCC-3'   (SEQ ID NO: 2612)

5'-GCUUCUACCAGCUCACCAAGCUCCU-3'    (SEQ ID NO: 3018)
                 3'-UGCGAAGAUGGUCGAGUGGUUCGAGGA-5'  (SEQ ID NO: 2208)

AR-3706 Target:  5'-ACGCTTCTACCAGCTCACCAAGCTCCT-3'   (SEQ ID NO: 2613)

5'-CUUCUACCAGCUCACCAAGCUCCUG-3'    (SEQ ID NO: 3019)
                 3'-GCGAAGAUGGUCGAGUGGUUCGAGGAC-5'  (SEQ ID NO: 2209)

AR-3707 Target:  5'-CGCTTCTACCAGCTCACCAAGCTCCTG-3'   (SEQ ID NO: 2614)

5'-UUCUACCAGCUCACCAAGCUCCUGG-3'    (SEQ ID NO: 3020)
                 3'-CGAAGAUGGUCGAGUGGUUCGAGGACC-5'  (SEQ ID NO: 2210)

AR-3708 Target:  5'-GCTTCTACCAGCTCACCAAGCTCCTGG-3'   (SEQ ID NO: 2615)

5'-UCUACCAGCUCACCAAGCUCCUGGA-3'    (SEQ ID NO: 3021)
                 3'-GAAGAUGGUCGAGUGGUUCGAGGACCU-5'  (SEQ ID NO: 2211)

AR-3709 Target:  5'-CTTCTACCAGCTCACCAAGCTCCTGGA-3'   (SEQ ID NO: 2616)

5'-CUACCAGCUCACCAAGCUCCUGGAC-3'    (SEQ ID NO: 3022)
                 3'-AAGAUGGUCGAGUGGUUCGAGGACCUG-5'  (SEQ ID NO: 2212)

AR-3710 Target:  5'-TTCTACCAGCTCACCAAGCTCCTGGAC-3'   (SEQ ID NO: 2617)

5'-UACCAGCUCACCAAGCUCCUGGACU-3'    (SEQ ID NO: 3023)
                 3'-AGAUGGUCGAGUGGUUCGAGGACCUGA-5'  (SEQ ID NO: 2213)

AR-3711 Target:  5'-TCTACCAGCTCACCAAGCTCCTGGACT-3'   (SEQ ID NO: 2618)

5'-ACCAGCUCACCAAGCUCCUGGACUC-3'    (SEQ ID NO: 3024)
                 3'-GAUGGUCGAGUGGUUCGAGGACCUGAG-5'  (SEQ ID NO: 2214)

AR-3712 Target:  5'-CTACCAGCTCACCAAGCTCCTGGACTC-3'   (SEQ ID NO: 2619)

5'-CCAGCUCACCAAGCUCCUGGACUCC-3'    (SEQ ID NO: 3025)
                 3'-AUGGUCGAGUGGUUCGAGGACCUGAGG-5'  (SEQ ID NO: 2215)

AR-3713 Target:  5'-TACCAGCTCACCAAGCTCCTGGACTCC-3'   (SEQ ID NO: 2620)

5'-CAGCUCACCAAGCUCCUGGACUCCG-3'    (SEQ ID NO: 3026)
                 3'-UGGUCGAGUGGUUCGAGGACCUGAGGC-5'  (SEQ ID NO: 2216)

AR-3714 Target:  5'-ACCAGCTCACCAAGCTCCTGGACTCCG-3'   (SEQ ID NO: 2621)

5'-AGCUCACCAAGCUCCUGGACUCCGU-3'    (SEQ ID NO: 3027)
                 3'-GGUCGAGUGGUUCGAGGACCUGAGGCA-5'  (SEQ ID NO: 2217)

AR-3715 Target:  5'-CCAGCTCACCAAGCTCCTGGACTCCGT-3'   (SEQ ID NO: 2622)

5'-CUCACCAAGCUCCUGGACUCCGUGC-3'    (SEQ ID NO: 3028)
                 3'-UCGAGUGGUUCGAGGACCUGAGGCACG-5'  (SEQ ID NO: 2218)

AR-3717 Target:  5'-AGCTCACCAAGCTCCTGGACTCCGTGC-3'   (SEQ ID NO: 2623)

5'-CUCCUGGACUCCGUGCAGCCUAUUG-3'    (SEQ ID NO: 3029)
                 3'-UCGAGGACCUGAGGCACGUCGGAUAAC-5'  (SEQ ID NO: 2219)

AR-3726 Target:  5'-AGCTCCTGGACTCCGTGCAGCCTATTG-3'   (SEQ ID NO: 2624)

5'-CGUGCAGCCUAUUGCGAGAGAGCUG-3'    (SEQ ID NO: 3030)
                 3'-AGGCACGUCGGAUAACGCUCUCUCGAC-5'  (SEQ ID NO: 2220)

AR-3737 Target:  5'-TCCGTGCAGCCTATTGCGAGAGAGCTG-3'   (SEQ ID NO: 2625)

5'-AGAGAGCUGCAUCAGUUCACUUUUG-3'    (SEQ ID NO: 3031)
                 3'-GCUCUCUCGACGUAGUCAAGUGAAAAC-5'  (SEQ ID NO: 2221)

AR-3753 Target:  5'-CGAGAGAGCTGCATCAGTTCACTTTTG-3'   (SEQ ID NO: 2626)

5'-GAGAGCUGCAUCAGUUCACUUUUGA-3'    (SEQ ID NO: 3032)
                 3'-CUCUCUCGACGUAGUCAAGUGAAAACU-5'  (SEQ ID NO: 2222)
```

TABLE 11-continued

AR Duplexes, Unmodified forms of Tested Duplexes, Human

```
AR-3754 Target:   5'-GAGAGAGCTGCATCAGTTCACTTTTGA-3'    (SEQ ID NO: 2627)

5'-AGAGCUGCAUCAGUUCACUUUUGAC-3'     (SEQ ID NO: 3033)
                  3'-UCUCUCGACGUAGUCAAGUGAAAACUG-5'   (SEQ ID NO: 2223)

AR-3755 Target:   5'-AGAGAGCTGCATCAGTTCACTTTTGAC-3'   (SEQ ID NO: 2628)

5'-GAGCUGCAUCAGUUCACUUUUGACC-3'     (SEQ ID NO: 3034)
                  3'-CUCUCGACGUAGUCAAGUGAAAACUGG-5'   (SEQ ID NO: 2224)

AR-3756 Target:   5'-GAGAGCTGCATCAGTTCACTTTTGACC-3'   (SEQ ID NO: 2629)

5'-AGCUGCAUCAGUUCACUUUUGACCU-3'     (SEQ ID NO: 3035)
                  3'-UCUCGACGUAGUCAAGUGAAAACUGGA-5'   (SEQ ID NO: 2225)

AR-3757 Target:   5'-AGAGCTGCATCAGTTCACTTTTGACCT-3'   (SEQ ID NO: 2630)

5'-GCUGCAUCAGUUCACUUUUGACCUG-3'     (SEQ ID NO: 3036)
                  3'-CUCGACGUAGUCAAGUGAAAACUGGAC-5'   (SEQ ID NO: 2226)

AR-3758 Target:   5'-GAGCTGCATCAGTTCACTTTTGACCTG-3'   (SEQ ID NO: 2631)

5'-CUGCAUCAGUUCACUUUUGACCUGC-3'     (SEQ ID NO: 3037)
                  3'-UCGACGUAGUCAAGUGAAAACUGGACG-5'   (SEQ ID NO: 2227)

AR-3759 Target:   5'-AGCTGCATCAGTTCACTTTTGACCTGC-3'   (SEQ ID NO: 2632)

5'-UGCAUCAGUUCACUUUUGACCUGCU-3'     (SEQ ID NO: 3038)
                  3'-CGACGUAGUCAAGUGAAAACUGGACGA-5'   (SEQ ID NO: 2228)

AR-3760 Target:   5'-GCTGCATCAGTTCACTTTTGACCTGCT-3'   (SEQ ID NO: 2633)

5'-GCAUCAGUUCACUUUUGACCUGCUA-3'     (SEQ ID NO: 3039)
                  3'-GACGUAGUCAAGUGAAAACUGGACGAU-5'   (SEQ ID NO: 2229)

AR-3761 Target:   5'-CTGCATCAGTTCACTTTTGACCTGCTA-3'   (SEQ ID NO: 2634)

5'-CAUCAGUUCACUUUUGACCUGCUAA-3'     (SEQ ID NO: 3040)
                  3'-ACGUAGUCAAGUGAAAACUGGACGAUU-5'   (SEQ ID NO: 2230)

AR-3762 Target:   5'-TGCATCAGTTCACTTTTGACCTGCTAA-3'   (SEQ ID NO: 2635)

5'-AUCAGUUCACUUUUGACCUGCUAAU-3'     (SEQ ID NO: 3041)
                  3'-CGUAGUCAAGUGAAAACUGGACGAUUA-5'   (SEQ ID NO: 2231)

AR-3763 Target:   5'-GCATCAGTTCACTTTTGACCTGCTAAT-3'   (SEQ ID NO: 2636)

5'-UCAGUUCACUUUUGACCUGCUAAUC-3'     (SEQ ID NO: 3042)
                  3'-GUAGUCAAGUGAAAACUGGACGAUUAG-5'   (SEQ ID NO: 2232)

AR-3764 Target:   5'-CATCAGTTCACTTTTGACCTGCTAATC-3'   (SEQ ID NO: 2637)

5'-CAGUUCACUUUUGACCUGCUAAUCA-3'     (SEQ ID NO: 3043)
                  3'-UAGUCAAGUGAAAACUGGACGAUUAGU-5'   (SEQ ID NO: 2233)

AR-3765 Target:   5'-ATCAGTTCACTTTTGACCTGCTAATCA-3'   (SEQ ID NO: 2638)

5'-AGUUCACUUUUGACCUGCUAAUCAA-3'     (SEQ ID NO: 3044)
                  3'-AGUCAAGUGAAAACUGGACGAUUAGUU-5'   (SEQ ID NO: 2234)

AR-3766 Target:   5'-TCAGTTCACTTTTGACCTGCTAATCAA-3'   (SEQ ID NO: 2639)

5'-GUUCACUUUUGACCUGCUAAUCAAG-3'     (SEQ ID NO: 3045)
                  3'-GUCAAGUGAAAACUGGACGAUUAGUUC-5'   (SEQ ID NO: 2235)

AR-3767 Target:   5'-CAGTTCACTTTTGACCTGCTAATCAAG-3'   (SEQ ID NO: 2640)

5'-UUCACUUUUGACCUGCUAAUCAAGU-3'     (SEQ ID NO: 3046)
                  3'-UCAAGUGAAAACUGGACGAUUAGUUCA-5'   (SEQ ID NO: 2236)

AR-3768 Target:   5'-AGTTCACTTTTGACCTGCTAATCAAGT-3'   (SEQ ID NO: 2641)

5'-UCACUUUUGACCUGCUAAUCAAGUC-3'     (SEQ ID NO: 3047)
                  3'-CAAGUGAAAACUGGACGAUUAGUUCAG-5'   (SEQ ID NO: 2237)
```

TABLE 11-continued

AR Duplexes, Unmodified forms of Tested Duplexes, Human

```
AR-3769 Target:  5'-GTTCACTTTTGACCTGCTAATCAAGTC-3'   (SEQ ID NO: 2642)

5'-CACUUUUGACCUGCUAAUCAAGUCA-3'    (SEQ ID NO: 3048)
                 3'-AAGUGAAAACUGGACGAUUAGUUCAGU-5'  (SEQ ID NO: 2238)

AR-3770 Target:  5'-TTCACTTTTGACCTGCTAATCAAGTCA-3'   (SEQ ID NO: 2643)

5'-ACUUUUGACCUGCUAAUCAAGUCAC-3'    (SEQ ID NO: 3049)
                 3'-AGUGAAAACUGGACGAUUAGUUCAGUG-5'  (SEQ ID NO: 2239)

AR-3771 Target:  5'-TCACTTTTGACCTGCTAATCAAGTCAC-3'   (SEQ ID NO: 2644)

5'-CUUUUGACCUGCUAAUCAAGUCACA-3'    (SEQ ID NO: 3050)
                 3'-GUGAAAACUGGACGAUUAGUUCAGUGU-5'  (SEQ ID NO: 2240)

AR-3772 Target:  5'-CACTTTTGACCTGCTAATCAAGTCACA-3'   (SEQ ID NO: 2645)

5'-UUUUGACCUGCUAAUCAAGUCACAC-3'    (SEQ ID NO: 3051)
                 3'-UGAAAACUGGACGAUUAGUUCAGUGUG-5'  (SEQ ID NO: 2241)

AR-3773 Target:  5'-ACTTTTGACCTGCTAATCAAGTCACAC-3'   (SEQ ID NO: 2646)

5'-AUGGUGAGCGUGGACUUUCCGGAAA-3'    (SEQ ID NO: 3052)
                 3'-UGUACCACUCGCACCUGAAAGGCCUUU-5'  (SEQ ID NO: 2242)

AR-3798 Target:  5'-ACATGGTGAGCGTGGACTTTCCGGAAA-3'   (SEQ ID NO: 2647)

5'-UGGUGAGCGUGGACUUUCCGGAAAU-3'    (SEQ ID NO: 3053)
                 3'-GUACCACUCGCACCUGAAAGGCCUUUA-5'  (SEQ ID NO: 2243)

AR-3799 Target:  5'-CATGGTGAGCGTGGACTTTCCGGAAAT-3'   (SEQ ID NO: 2648)

5'-GAAAUGAUGGCAGAGAUCAUCUCUG-3'    (SEQ ID NO: 3054)
                 3'-GCCUUUACUACCGUCUCUAGUAGAGAC-5'  (SEQ ID NO: 2244)

AR-3819 Target:  5'-CGGAAATGATGGCAGAGATCATCTCTG-3'   (SEQ ID NO: 2649)

5'-AAAUGAUGGCAGAGAUCAUCUCUGU-3'    (SEQ ID NO: 3055)
                 3'-CCUUUACUACCGUCUCUAGUAGAGACA-5'  (SEQ ID NO: 2245)

AR-3820 Target:  5'-GGAAATGATGGCAGAGATCATCTCTGT-3'   (SEQ ID NO: 2650)

5'-AAUGAUGGCAGAGAUCAUCUCUGUG-3'    (SEQ ID NO: 3056)
                 3'-CUUUACUACCGUCUCUAGUAGAGACAC-5'  (SEQ ID NO: 2246)

AR-3821 Target:  5'-GAAATGATGGCAGAGATCATCTCTGTG-3'   (SEQ ID NO: 2651)

5'-AUGAUGGCAGAGAUCAUCUCUGUGC-3'    (SEQ ID NO: 3057)
                 3'-UUUACUACCGUCUCUAGUAGAGACACG-5'  (SEQ ID NO: 2247)

AR-3822 Target:  5'-AAATGATGGCAGAGATCATCTCTGTGC-3'   (SEQ ID NO: 2652)

5'-UGAUGGCAGAGAUCAUCUCUGUGCA-3'    (SEQ ID NO: 3058)
                 3'-UUACUACCGUCUCUAGUAGAGACACGU-5'  (SEQ ID NO: 2248)

AR-3823 Target:  5'-AATGATGGCAGAGATCATCTCTGTGCA-3'   (SEQ ID NO: 2653)

5'-GAUGGCAGAGAUCAUCUCUGUGCAA-3'    (SEQ ID NO: 3059)
                 3'-UACUACCGUCUCUAGUAGAGACACGUU-5'  (SEQ ID NO: 2249)

AR-3824 Target:  5'-ATGATGGCAGAGATCATCTCTGTGCAA-3'   (SEQ ID NO: 2654)

5'-AUGGCAGAGAUCAUCUCUGUGCAAG-3'    (SEQ ID NO: 3060)
                 3'-ACUACCGUCUCUAGUAGAGACACGUUC-5'  (SEQ ID NO: 2250)

AR-3825 Target:  5'-TGATGGCAGAGATCATCTCTGTGCAAG-3'   (SEQ ID NO: 2655)

5'-UGGCAGAGAUCAUCUCUGUGCAAGU-3'    (SEQ ID NO: 3061)
                 3'-CUACCGUCUCUAGUAGAGACACGUUCA-5'  (SEQ ID NO: 2251)

AR-3826 Target:  5'-GATGGCAGAGATCATCTCTGTGCAAGT-3'   (SEQ ID NO: 2656)

5'-GGCAGAGAUCAUCUCUGUGCAAGUG-3'    (SEQ ID NO: 3062)
                 3'-UACCGUCUCUAGUAGAGACACGUUCAC-5'  (SEQ ID NO: 2252)
```

TABLE 11-continued

AR Duplexes, Unmodified forms of Tested Duplexes, Human

```
AR-3827 Target:  5'-ATGGCAGAGATCATCTCTGTGCAAGTG-3'     (SEQ ID NO: 2657)

5'-GCAGAGAUCAUCUCUGUGCAAGUGC-3'      (SEQ ID NO: 3063)
                 3'-ACCGUCUCUAGUAGAGACACGUUCACG-5'    (SEQ ID NO: 2253)

AR-3828 Target:  5'-TGGCAGAGATCATCTCTGTGCAAGTGC-3'    (SEQ ID NO: 2658)

5'-CAGAGAUCAUCUCUGUGCAAGUGCC-3'      (SEQ ID NO: 3064)
                 3'-CCGUCUCUAGUAGAGACACGUUCACGG-5'    (SEQ ID NO: 2254)

AR-3829 Target:  5'-GGCAGAGATCATCTCTGTGCAAGTGCC-3'    (SEQ ID NO: 2659)

5'-AGAGAUCAUCUCUGUGCAAGUGCCC-3'      (SEQ ID NO: 3065)
                 3'-CGUCUCUAGUAGAGACACGUUCACGGG-5'    (SEQ ID NO: 2255)

AR-3830 Target:  5'-GCAGAGATCATCTCTGTGCAAGTGCCC-3'    (SEQ ID NO: 2660)

5'-GAGAUCAUCUCUGUGCAAGUGCCCA-3'      (SEQ ID NO: 3066)
                 3'-GUCUCUAGUAGAGACACGUUCACGGGU-5'    (SEQ ID NO: 2256)

AR-3831 Target:  5'-CAGAGATCATCTCTGTGCAAGTGCCCA-3'    (SEQ ID NO: 2661)

5'-AGAUCAUCUCUGUGCAAGUGCCCAA-3'      (SEQ ID NO: 3067)
                 3'-UCUCUAGUAGAGACACGUUCACGGGUU-5'    (SEQ ID NO: 2257)

AR-3832 Target:  5'-AGAGATCATCTCTGTGCAAGTGCCCAA-3'    (SEQ ID NO: 2662)

5'-GAUCAUCUCUGUGCAAGUGCCCAAG-3'      (SEQ ID NO: 3068)
                 3'-CUCUAGUAGAGACACGUUCACGGGUUC-5'    (SEQ ID NO: 2258)

AR-3833 Target:  5'-GAGATCATCTCTGTGCAAGTGCCCAAG-3'    (SEQ ID NO: 2663)

5'-AUCAUCUCUGUGCAAGUGCCCAAGA-3'      (SEQ ID NO: 3069)
                 3'-UCUAGUAGAGACACGUUCACGGGUUCU-5'    (SEQ ID NO: 2259)

AR-3834 Target:  5'-AGATCATCTCTGTGCAAGTGCCCAAGA-3'    (SEQ ID NO: 2664)

5'-UCAUCUCUGUGCAAGUGCCCAAGAU-3'      (SEQ ID NO: 3070)
                 3'-CUAGUAGAGACACGUUCACGGGUUCUA-5'    (SEQ ID NO: 2260)

AR-3835 Target:  5'-GATCATCTCTGTGCAAGTGCCCAAGAT-3'    (SEQ ID NO: 2665)

5'-CAUCUCUGUGCAAGUGCCCAAGAUC-3'      (SEQ ID NO: 3071)
                 3'-UAGUAGAGACACGUUCACGGGUUCUAG-5'    (SEQ ID NO: 2261)

AR-3836 Target:  5'-ATCATCTCTGTGCAAGTGCCCAAGATC-3'    (SEQ ID NO: 2666)

5'-AUCUCUGUGCAAGUGCCCAAGAUCC-3'      (SEQ ID NO: 3072)
                 3'-AGUAGAGACACGUUCACGGGUUCUAGG-5'    (SEQ ID NO: 2262)

AR-3837 Target:  5'-TCATCTCTGTGCAAGTGCCCAAGATCC-3'    (SEQ ID NO: 2667)

5'-UCUCUGUGCAAGUGCCCAAGAUCCU-3'      (SEQ ID NO: 3073)
                 3'-GUAGAGACACGUUCACGGGUUCUAGGA-5'    (SEQ ID NO: 2263)

AR-3838 Target:  5'-CATCTCTGTGCAAGTGCCCAAGATCCT-3'    (SEQ ID NO: 2668)

5'-CUCUGUGCAAGUGCCCAAGAUCCUU-3'      (SEQ ID NO: 3074)
                 3'-UAGAGACACGUUCACGGGUUCUAGGAA-5'    (SEQ ID NO: 2264)

AR-3839 Target:  5'-ATCTCTGTGCAAGTGCCCAAGATCCTT-3'    (SEQ ID NO: 2669)

5'-UCUGUGCAAGUGCCCAAGAUCCUUU-3'      (SEQ ID NO: 3075)
                 3'-AGAGACACGUUCACGGGUUCUAGGAAA-5'    (SEQ ID NO: 2265)

AR-3840 Target:  5'-TCTCTGTGCAAGTGCCCAAGATCCTTT-3'    (SEQ ID NO: 2670)

5'-CUGUGCAAGUGCCCAAGAUCCUUUC-3'      (SEQ ID NO: 3076)
                 3'-GAGACACGUUCACGGGUUCUAGGAAAG-5'    (SEQ ID NO: 2266)

AR-3841 Target:  5'-CTCTGTGCAAGTGCCCAAGATCCTTTC-3'    (SEQ ID NO: 2671)

5'-UGUGCAAGUGCCCAAGAUCCUUUCU-3'      (SEQ ID NO: 3077)
                 3'-AGACACGUUCACGGGUUCUAGGAAAGA-5'    (SEQ ID NO: 2267)
```

TABLE 11-continued

AR Duplexes, Unmodified forms of Tested Duplexes, Human

```
AR-3842  Target:  5'-TCTGTGCAAGTGCCCAAGATCCTTTCT-3'      (SEQ ID NO: 2672)

5'-GUGCAAGUGCCCAAGAUCCUUUCUG-3'        (SEQ ID NO: 3078)
                  3'-GACACGUUCACGGGUUCUAGGAAAGAC-5'      (SEQ ID NO: 2268)

AR-3843  Target:  5'-CTGTGCAAGTGCCCAAGATCCTTTCTG-3'      (SEQ ID NO: 2673)

5'-UGCAAGUGCCCAAGAUCCUUUCUGG-3'        (SEQ ID NO: 3079)
                  3'-ACACGUUCACGGGUUCUAGGAAAGACC-5'      (SEQ ID NO: 2269)

AR-3844  Target:  5'-TGTGCAAGTGCCCAAGATCCTTTCTGG-3'      (SEQ ID NO: 2674)

5'-GCAAGUGCCCAAGAUCCUUUCUGGG-3'        (SEQ ID NO: 3080)
                  3'-CACGUUCACGGGUUCUAGGAAAGACCC-5'      (SEQ ID NO: 2270)

AR-3845  Target:  5'-GTGCAAGTGCCCAAGATCCTTTCTGGG-3'      (SEQ ID NO: 2675)

5'-CAAGUGCCCAAGAUCCUUUCUGGGA-3'        (SEQ ID NO: 3081)
                  3'-ACGUUCACGGGUUCUAGGAAAGACCCU-5'      (SEQ ID NO: 2271)

AR-3846  Target:  5'-TGCAAGTGCCCAAGATCCTTTCTGGGA-3'      (SEQ ID NO: 2676)

5'-AAGUGCCCAAGAUCCUUUCUGGGAA-3'        (SEQ ID NO: 3082)
                  3'-CGUUCACGGGUUCUAGGAAAGACCCUU-5'      (SEQ ID NO: 2272)

AR-3847  Target:  5'-GCAAGTGCCCAAGATCCTTTCTGGGAA-3'      (SEQ ID NO: 2677)

5'-AGUGCCCAAGAUCCUUUCUGGGAAA-3'        (SEQ ID NO: 3083)
                  3'-GUUCACGGGUUCUAGGAAAGACCCUUU-5'      (SEQ ID NO: 2273)

AR-3848  Target:  5'-CAAGTGCCCAAGATCCTTTCTGGGAAA-3'      (SEQ ID NO: 2678)

5'-GUGCCCAAGAUCCUUUCUGGGAAAG-3'        (SEQ ID NO: 3084)
                  3'-UUCACGGGUUCUAGGAAAGACCCUUUC-5'      (SEQ ID NO: 2274)

AR-3849  Target:  5'-AAGTGCCCAAGATCCTTTCTGGGAAAG-3'      (SEQ ID NO: 2679)

5'-UGCCCAAGAUCCUUUCUGGGAAAGU-3'        (SEQ ID NO: 3085)
                  3'-UCACGGGUUCUAGGAAAGACCCUUUCA-5'      (SEQ ID NO: 2275)

AR-3850  Target:  5'-AGTGCCCAAGATCCTTTCTGGGAAAGT-3'      (SEQ ID NO: 2680)

5'-GCCCAAGAUCCUUUCUGGGAAAGUC-3'        (SEQ ID NO: 3086)
                  3'-CACGGGUUCUAGGAAAGACCCUUUCAG-5'      (SEQ ID NO: 2276)

AR-3851  Target:  5'-GTGCCCAAGATCCTTTCTGGGAAAGTC-3'      (SEQ ID NO: 2681)

5'-CCCAAGAUCCUUUCUGGGAAAGUCA-3'        (SEQ ID NO: 3087)
                  3'-ACGGGUUCUAGGAAAGACCCUUUCAGU-5'      (SEQ ID NO: 2277)

AR-3852  Target:  5'-TGCCCAAGATCCTTTCTGGGAAAGTCA-3'      (SEQ ID NO: 2682)

5'-CCAAGAUCCUUUCUGGGAAAGUCAA-3'        (SEQ ID NO: 3088)
                  3'-CGGGUUCUAGGAAAGACCCUUUCAGUU-5'      (SEQ ID NO: 2278)

AR-3853  Target:  5'-GCCCAAGATCCTTTCTGGGAAAGTCAA-3'      (SEQ ID NO: 2683)

5'-CAAGAUCCUUUCUGGGAAAGUCAAG-3'        (SEQ ID NO: 3089)
                  3'-GGGUUCUAGGAAAGACCCUUUCAGUUC-5'      (SEQ ID NO: 2279)

AR-3854  Target:  5'-CCCAAGATCCTTTCTGGGAAAGTCAAG-3'      (SEQ ID NO: 2684)

5'-AAGAUCCUUUCUGGGAAAGUCAAGC-3'        (SEQ ID NO: 3090)
                  3'-GGUUCUAGGAAAGACCCUUUCAGUUCG-5'      (SEQ ID NO: 2280)

AR-3855  Target:  5'-CCAAGATCCTTTCTGGGAAAGTCAAGC-3'      (SEQ ID NO: 2685)

5'-AGAUCCUUUCUGGGAAAGUCAAGCC-3'        (SEQ ID NO: 3091)
                  3'-GUUCUAGGAAAGACCCUUUCAGUUCGG-5'      (SEQ ID NO: 2281)

AR-3856  Target:  5'-CAAGATCCTTTCTGGGAAAGTCAAGCC-3'      (SEQ ID NO: 2686)

5'-GAUCCUUUCUGGGAAAGUCAAGCCC-3'        (SEQ ID NO: 3092)
                  3'-UUCUAGGAAAGACCCUUUCAGUUCGGG-5'      (SEQ ID NO: 2282)
```

TABLE 11-continued

AR Duplexes, Unmodified forms of Tested Duplexes, Human

```
AR-3857 Target:  5'-AAGATCCTTTCTGGGAAAGTCAAGCCC-3'    (SEQ ID NO: 2687)

5'-AUCCUUUCUGGGAAAGUCAAGCCCA-3'     (SEQ ID NO: 3093)
                 3'-UCUAGGAAAGACCCUUUCAGUUCGGGU-5'   (SEQ ID NO: 2283)

AR-3858 Target:  5'-AGATCCTTTCTGGGAAAGTCAAGCCCA-3'    (SEQ ID NO: 2688)

5'-UCCUUUCUGGGAAAGUCAAGCCCAU-3'     (SEQ ID NO: 3094)
                 3'-CUAGGAAAGACCCUUUCAGUUCGGGUA-5'   (SEQ ID NO: 2284)

AR-3859 Target:  5'-GATCCTTTCTGGGAAAGTCAAGCCCAT-3'    (SEQ ID NO: 2689)

5'-CCUUUCUGGGAAAGUCAAGCCCAUC-3'     (SEQ ID NO: 3095)
                 3'-UAGGAAAGACCCUUUCAGUUCGGGUAG-5'   (SEQ ID NO: 2285)

AR-3860 Target:  5'-ATCCTTTCTGGGAAAGTCAAGCCCATC-3'    (SEQ ID NO: 2690)

5'-CUUUCUGGGAAAGUCAAGCCCAUCU-3'     (SEQ ID NO: 3096)
                 3'-AGGAAAGACCCUUUCAGUUCGGGUAGA-5'   (SEQ ID NO: 2286)

AR-3861 Target:  5'-TCCTTTCTGGGAAAGTCAAGCCCATCT-3'    (SEQ ID NO: 2691)

5'-UUUCUGGGAAAGUCAAGCCCAUCUA-3'     (SEQ ID NO: 3097)
                 3'-GGAAAGACCCUUUCAGUUCGGGUAGAU-5'   (SEQ ID NO: 2287)

AR-3862 Target:  5'-CCTTTCTGGGAAAGTCAAGCCCATCTA-3'    (SEQ ID NO: 2692)

5'-UUCUGGGAAAGUCAAGCCCAUCUAU-3'     (SEQ ID NO: 3098)
                 3'-GAAAGACCCUUUCAGUUCGGGUAGAUA-5'   (SEQ ID NO: 2288)

AR-3863 Target:  5'-CTTTCTGGGAAAGTCAAGCCCATCTAT-3'    (SEQ ID NO: 2693)

5'-UCUGGGAAAGUCAAGCCCAUCUAUU-3'     (SEQ ID NO: 3099)
                 3'-AAAGACCCUUUCAGUUCGGGUAGAUAA-5'   (SEQ ID NO: 2289)

AR-3864 Target:  5'-TTTCTGGGAAAGTCAAGCCCATCTATT-3'    (SEQ ID NO: 2694)

5'-CUGGGAAAGUCAAGCCCAUCUAUUU-3'     (SEQ ID NO: 3100)
                 3'-AAGACCCUUUCAGUUCGGGUAGAUAAA-5'   (SEQ ID NO: 2290)

AR-3865 Target:  5'-TTCTGGGAAAGTCAAGCCCATCTATTT-3'    (SEQ ID NO: 2695)

5'-UGGGAAAGUCAAGCCCAUCUAUUUC-3'     (SEQ ID NO: 3101)
                 3'-AGACCCUUUCAGUUCGGGUAGAUAAAG-5'   (SEQ ID NO: 2291)

AR-3866 Target:  5'-TCTGGGAAAGTCAAGCCCATCTATTTC-3'    (SEQ ID NO: 2696)

5'-GGGAAAGUCAAGCCCAUCUAUUUCC-3'     (SEQ ID NO: 3102)
                 3'-GACCCUUUCAGUUCGGGUAGAUAAAGG-5'   (SEQ ID NO: 2292)

AR-3867 Target:  5'-CTGGGAAAGTCAAGCCCATCTATTTCC-3'    (SEQ ID NO: 2697)

5'-GGAAAGUCAAGCCCAUCUAUUUCCA-3'     (SEQ ID NO: 3103)
                 3'-ACCCUUUCAGUUCGGGUAGAUAAAGGU-5'   (SEQ ID NO: 2293)

AR-3868 Target:  5'-TGGGAAAGTCAAGCCCATCTATTTCCA-3'    (SEQ ID NO: 2698)

5'-GAAAGUCAAGCCCAUCUAUUUCCAC-3'     (SEQ ID NO: 3104)
                 3'-CCCUUUCAGUUCGGGUAGAUAAAGGUG-5'   (SEQ ID NO: 2294)

AR-3869 Target:  5'-GGGAAAGTCAAGCCCATCTATTTCCAC-3'    (SEQ ID NO: 2699)

5'-AAAGUCAAGCCCAUCUAUUUCCACA-3'     (SEQ ID NO: 3105)
                 3'-CCUUUCAGUUCGGGUAGAUAAAGGUGU-5'   (SEQ ID NO: 2295)

AR-3870 Target:  5'-GGAAAGTCAAGCCCATCTATTTCCACA-3'    (SEQ ID NO: 2700)

5'-AAGUCAAGCCCAUCUAUUUCCACAC-3'     (SEQ ID NO: 3106)
                 3'-CUUUCAGUUCGGGUAGAUAAAGGUGUG-5'   (SEQ ID NO: 2296)

AR-3871 Target:  5'-GAAAGTCAAGCCCATCTATTTCCACAC-3'    (SEQ ID NO: 2701)

5'-CAGAUGUCUUCUGCCGUUAUAACU-3'     (SEQ ID NO: 3107)
                 3'-AAGUCUACAGAAGACGGACAAUAUUGA-5'  (SEQ ID NO: 2297)
```

TABLE 11-continued

AR Duplexes, Unmodified forms of Tested Duplexes, Human

```
AR-3947 Target:  5'-TTCAGATGTCTTCTGCCTGTTATAACT-3'    (SEQ ID NO: 2702)

5'-AGAUGUCUUCUGCCUGUUAUAACUC-3'      (SEQ ID NO: 3108)
                 3'-AGUCUACAGAAGACGGACAAUAUUGAG-5'    (SEQ ID NO: 2298)

AR-3948 Target:  5'-TCAGATGTCTTCTGCCTGTTATAACTC-3'    (SEQ ID NO: 2703)

5'-GAUGUCUUCUGCCUGUUAUAACUCU-3'     (SEQ ID NO: 3109)
                 3'-GUCUACAGAAGACGGACAAUAUUGAGA-5'    (SEQ ID NO: 2299)

AR-3949 Target:  5'-CAGATGTCTTCTGCCTGTTATAACTCT-3'    (SEQ ID NO: 2704)

5'-AUGUCUUCUGCCUGUUAUAACUCUG-3'     (SEQ ID NO: 3110)
                 3'-UCUACAGAAGACGGACAAUAUUGAGAC-5'    (SEQ ID NO: 2300)

AR-3950 Target:  5'-AGATGTCTTCTGCCTGTTATAACTCTG-3'    (SEQ ID NO: 2705)

5'-GGAAUUUCCUCUAUUGAUGUACAGU-3'     (SEQ ID NO: 3111)
                 3'-CCCCUUAAAGGAGAUAACUACAUGUCA-5'    (SEQ ID NO: 2301)

AR-3999 Target:  5'-GGGGAATTTCCTCTATTGATGTACAGT-3'    (SEQ ID NO: 2706)

5'-GCUGGGCUUUUUUUUCUCUUUCUC-3'      (SEQ ID NO: 3112)
                 3'-AACGACCCGAAAAAAAAAGAGAAAGAG-5'    (SEQ ID NO: 2302)

AR-4054 Target:  5'-TTGCTGGGCTTTTTTTTCTCTTTCTC-3'     (SEQ ID NO: 2707)

5'-CUGGGCUUUUUUUUCUCUUUCUCU-3'      (SEQ ID NO: 3113)
                 3'-ACGACCCGAAAAAAAAAGAGAAAGAGA-5'    (SEQ ID NO: 2303)

AR-4055 Target:  5'-TGCTGGGCTTTTTTTTCTCTTTCTCT-3'     (SEQ ID NO: 2708)

5'-UUUUUUUUUCUCUUUCUCUCCUUUC-3'     (SEQ ID NO: 3114)
                 3'-CGAAAAAAAAAGAGAAAGAGAGGAAAG-5'    (SEQ ID NO: 2304)

AR-4061 Target:  5'-GCTTTTTTTTCTCTTTCTCTCCTTTC-3'     (SEQ ID NO: 2709)

5'-UUUUCUCUUUCUCUCCUUUCUUUUU-3'     (SEQ ID NO: 3115)
                 3'-AAAAAAGAGAAAGAGAGGAAAGAAAAA-5'    (SEQ ID NO: 2305)

AR-4066 Target:  5'-TTTTTTCTCTTTCTCTCCTTTCTTTTT-3'    (SEQ ID NO: 2710)

5'-UUUUUCUUCUUCCCUCCCUAUCUAA-3'     (SEQ ID NO: 3116)
                 3'-AGAAAAAGAAGAAGGGAGGGAUAGAUU-5'    (SEQ ID NO: 2306)

AR-4086 Target:  5'-TCTTTTTCTTCTTCCCTCCCTATCTAA-3'    (SEQ ID NO: 2711)

5'-UUGUAUGCCUUUAAAUCUGUGAUGA-3'     (SEQ ID NO: 3117)
                 3'-ACAACAUACGGAAAUUUAGACACUACU-5'    (SEQ ID NO: 2307)

AR-4174 Target:  5'-TGTTGTATGCCTTTAAATCTGTGATGA-3'    (SEQ ID NO: 2712)

5'-UGCUUGUUUACAGCACUACUCUGUG-3'     (SEQ ID NO: 3118)
                 3'-ACACGAACAAAUGUCGUGAUGAGACAC-5'    (SEQ ID NO: 2308)

AR-4225 Target:  5'-TGTGCTTGTTTACAGCACTACTCTGTG-3'    (SEQ ID NO: 2713)

5'-AGAGAGCUAAGAUUAUCUGGGGAAA-3'     (SEQ ID NO: 3119)
                 3'-AAUCUCUCGAUUCUAAUAGACCCCUUU-5'    (SEQ ID NO: 2309)

AR-4293 Target:  5'-TTAGAGAGCTAAGATTATCTGGGGAAA-3'    (SEQ ID NO: 2714)

5'-GGAAAUCAAAACAAAAACAAGCAAA-3'     (SEQ ID NO: 3120)
                 3'-CCCCUUUAGUUUUGUUUUUGUUCGUUU-5'    (SEQ ID NO: 2310)

AR-4313 Target:  5'-GGGGAAATCAAAACAAAAACAAGCAAA-3'    (SEQ ID NO: 2715)
```

TABLE 12

AR Duplexes, Unmodified Forms of Tested Duplexes, Mouse

```
                 5'-CAGCAGCACACUGAGGAUGGUUCUC-3'     (SEQ ID NO: 3670)
                 3'-CCGUCGUCGUGUGACUCCUACCAAGAG-5'    (SEQ ID NO: 3574)
```

TABLE 12-continued

AR Duplexes, Unmodified Forms of Tested Duplexes, Mouse

```
AR-m258 Target:  5'-GGCAGCAGCACACTGAGGATGGTTCTC-3'   (SEQ ID NO: 3622)

5'-CCGAGGGCCACCCUGAGAGCAGCUG-3'     (SEQ ID NO: 3671)
                 3'-GAGGCUCCCGGUGGGACUCUCGUCGAC-5'   (SEQ ID NO: 3575)

AR-m361 Target:  5'-CTCCGAGGGCCACCCTGAGAGCAGCTG-3'   (SEQ ID NO: 3623)

5'-GCCACCCUGAGAGCAGCUGCCUCCC-3'     (SEQ ID NO: 3672)
                 3'-CCCGGUGGGACUCUCGUCGACGGAGGG-5'   (SEQ ID NO: 3576)

AR-m367 Target:  5'-GGGCCACCCTGAGAGCAGCTGCCTCCC-3'   (SEQ ID NO: 3624)

5'-CUGCCGCAGCAGCCACCAGCUCCUC-3'     (SEQ ID NO: 3673)
                 3'-CCGACGGCGUCGUCGGUGGUCGAGGAG-5'   (SEQ ID NO: 3577)

AR-m426 Target:  5'-GGCTGCCGCAGCAGCCACCAGCTCCTC-3'   (SEQ ID NO: 3625)

5'-CUUUCCCAGGCUUAAGCAGCUGCUC-3'     (SEQ ID NO: 3674)
                 3'-GUGAAAGGGUCCGAAUUCGUCGACGAG-5'   (SEQ ID NO: 3578)

AR-m502 Target:  5'-CACTTTCCCAGGCTTAAGCAGCTGCTC-3'   (SEQ ID NO: 3626)

5'-GCAACUUCUUCAGCAGCAGCAACAA-3'     (SEQ ID NO: 3675)
                 3'-UACGUUGAAGAAGUCGUCGUCGUUGUU-5'   (SEQ ID NO: 3579)

AR-m566 Target:  5'-ATGCAACTTCTTCAGCAGCAGCAACAA-3'   (SEQ ID NO: 3627)

5'-GCGUCCCACUCCUUGUGCGCCGCUG-3'     (SEQ ID NO: 3676)
                 3'-CACGCAGGGUGAGGAACACGCGGCGAC-5'   (SEQ ID NO: 3580)

AR-m872 Target:  5'-GTGCGTCCCACTCCTTGTGCGCCGCTG-3'   (SEQ ID NO: 3628)

5'-GGCAGCAGUGAAGCAGGUAGCUCUG-3'     (SEQ ID NO: 3677)
                 3'-GACCGUCGUCACUUCGUCCAUCGAGAC-5'   (SEQ ID NO: 3581)

AR-m1020 Target: 5'-CTGGCAGCAGTGAAGCAGGTAGCTCTG-3'   (SEQ ID NO: 3629)

5'-UCCGCUGGCUCUGUCCGGGCCGCCG-3'     (SEQ ID NO: 3678)
                 3'-AAAGGCGACCGAGACAGGGCCCGGCGGC-5'  (SEQ ID NO: 3582)

AR-m1136 Target: 5'-TTTCCGCTGGCTCTGTCCGGGCCGCCG-3'   (SEQ ID NO: 3630)

5'-AGCGCCUGGGCUGCGGCGGCAGCGC-3'     (SEQ ID NO: 3679)
                 3'-CGUCGCGGACCCGACGCCGCCGUCGCG-5'   (SEQ ID NO: 3583)

AR-m1224 Target: 5'-GCAGCGCCTGGGCTGCGGCGGCAGCGC-3'   (SEQ ID NO: 3631)

5'-CUGGGCUGCGGCGGCAGCGCAAUGC-3'     (SEQ ID NO: 3680)
                 3'-CGGACCCGACGCCGCCGUCGCGUUACG-5'   (SEQ ID NO: 3584)

AR-m1229 Target: 5'-GCCTGGGCTGCGGCGGCAGCGCAATGC-3'   (SEQ ID NO: 3632)

5'-GCGGCGGCAGCGCAAUGCCGCUAUG-3'     (SEQ ID NO: 3681)
                 3'-GACGCCGCCGUCGCGUUACGGCGAUAC-5'   (SEQ ID NO: 3585)

AR-m1236 Target: 5'-CTGCGGCGGCAGCGCAATGCCGCTATG-3'   (SEQ ID NO: 3633)

5'-UAGCCGGGCCCAGCACUGGAUCGCC-3'     (SEQ ID NO: 3682)
                 3'-ACAUCGGCCCGGGUCGUGACCUAGCGG-5'   (SEQ ID NO: 3586)

AR-m1291 Target: 5'-TGTAGCCGGGCCCAGCACTGGATCGCC-3'   (SEQ ID NO: 3634)

5'-UCCUGGCAUACUCUCUUCACAGCUG-3'     (SEQ ID NO: 3683)
                 3'-GAAGGACCGUAUGAGAGAAGUGUCGAC-5'   (SEQ ID NO: 3587)

AR-m1335 Target: 5'-CTTCCTGGCATACTCTCTTCACAGCTG-3'   (SEQ ID NO: 3635)

5'-CAGCCCAAGCGAUGCCGGGCCUGUA-3'     (SEQ ID NO: 3684)
                 3'-UCGUCGGGUUCGCUACGGCCCGGACAU-5'   (SEQ ID NO: 3588)

AR-m1403 Target: 5'-AGCAGCCCAAGCGATGCCGGGCCTGTA-3'   (SEQ ID NO: 3636)

5'-UUCUGGCUGUCACUACGGAGCUCUC-3'     (SEQ ID NO: 3685)
                 3'-CGAAGACCGACAGUGAUGCCUCGAGAG-5'   (SEQ ID NO: 3589)
```

TABLE 12-continued

AR Duplexes, Unmodified Forms of Tested Duplexes, Mouse

```
AR-m1694  Target: 5'-GCTTCTGGCTGTCACTACGGAGCTCTC-3'      (SEQ ID NO: 3637)

5'-GAGCUCUCACUUGUGGCAGCUGCAA-3'        (SEQ ID NO: 3686)
                  3'-GCCUCGAGAGUGAACACCGUCGACGUU-5'      (SEQ ID NO: 3590)

AR-m1711  Target: 5'-CGGAGCTCTCACTTGTGGCAGCTGCAA-3'      (SEQ ID NO: 3638)

5'-CUUGUGGCAGCUGCAAGGUCUUCUU-3'        (SEQ ID NO: 3687)
                  3'-GUGAACACCGUCGACGUUCCAGAAGAA-5'      (SEQ ID NO: 3591)

AR-m1720  Target: 5'-CACTTGTGGCAGCTGCAAGGTCTTCTT-3'      (SEQ ID NO: 3639)

5'-GGCAGCUGCAAGGUCUUCUUCAAAA-3'        (SEQ ID NO: 3688)
                  3'-CACCGUCGACGUUCCAGAAGAAGUUUU-5'      (SEQ ID NO: 3592)

AR-m1725  Target: 5'-GTGGCAGCTGCAAGGTCTTCTTCAAAA-3'      (SEQ ID NO: 3640)

5'-GAUGACUCUGGGAGCUCGUAAGCUG-3'        (SEQ ID NO: 3689)
                  3'-CCCUACUGAGACCCUCGAGCAUUCGAC-5'      (SEQ ID NO: 3593)

AR-m1865  Target: 5'-GGGATGACTCTGGGAGCTCGTAAGCTG-3'      (SEQ ID NO: 3641)

5'-GGGAGCUCGUAAGCUGAAGAAACUU-3'        (SEQ ID NO: 3690)
                  3'-GACCCUCGAGCAUUCGACUUCUUUGAA-5'      (SEQ ID NO: 3594)

AR-m1874  Target: 5'-CTGGGAGCTCGTAAGCTGAAGAAACTT-3'      (SEQ ID NO: 3642)

5'-GAUUCCUUUGCUGCCUUGUUAUCUA-3'        (SEQ ID NO: 3691)
                  3'-GUCUAAGGAAACGACGGAACAAUAGAU-5'      (SEQ ID NO: 3595)

AR-m2079  Target: 5'-CAGATTCCTTTGCTGCCTTGTTATCTA-3'      (SEQ ID NO: 3643)

5'-UUGCUGCCUUGUUAUCUAGCCUCAA-3'        (SEQ ID NO: 3692)
                  3'-GAAACGACGGAACAAUAGAUCGGAGUU-5'      (SEQ ID NO: 3596)

AR-m2086  Target: 5'-CTTTGCTGCCTTGTTATCTAGCCTCAA-3'      (SEQ ID NO: 3644)

5'-GCCUGGCUUCCGCAACUUGCAUGUG-3'        (SEQ ID NO: 3693)
                  3'-AACGGACCGAAGGCGUUGAACGUACAC-5'      (SEQ ID NO: 3597)

AR-m2162  Target: 5'-TTGCCTGGCTTCCGCAACTTGCATGTG-3'      (SEQ ID NO: 3645)

5'-GAUGGGACUGAUGGUAUUUGCCAUG-3'        (SEQ ID NO: 3694)
                  3'-ACCUACCCUGACUACCAUAAACGGUAC-5'      (SEQ ID NO: 3598)

AR-m2219  Target: 5'-TGGATGGGACTGATGGTATTTGCCATG-3'      (SEQ ID NO: 3646)

5'-GGAUGCUCUACUUUGCACCUGACUU-3'        (SEQ ID NO: 3695)
                  3'-GUCCUACGAGAUGAAACGUGGACUGAA-5'      (SEQ ID NO: 3599)

AR-m2275  Target: 5'-CAGGATGCTCTACTTTGCACCTGACTT-3'      (SEQ ID NO: 3647)

5'-CUCUACUUUGCACCUGACUUGGUUU-3'        (SEQ ID NO: 3696)
                  3'-ACGAGAUGAAACGUGGACUGAACCAAA-5'      (SEQ ID NO: 3600)

AR-m2280  Target: 5'-TGCTCTACTTTGCACCTGACTTGGTTT-3'      (SEQ ID NO: 3648)

5'-UUGCACCUGACUUGGUUUUCAAUGA-3'        (SEQ ID NO: 3697)
                  3'-GAAACGUGGACUGAACCAAAAGUUACU-5'      (SEQ ID NO: 3601)

AR-m2287  Target: 5'-CTTTGCACCTGACTTGGTTTTCAATGA-3'      (SEQ ID NO: 3649)

5'-CUUGGUUUUCAAUGAGUACCGCAUG-3'        (SEQ ID NO: 3698)
                  3'-CUGAACCAAAAGUUACUCAUGGCGUAC-5'      (SEQ ID NO: 3602)

AR-m2297  Target: 5'-GACTTGGTTTTCAATGAGTACCGCATG-3'      (SEQ ID NO: 3650)

5'-GUACCGCAUGCACAAGUCUCGGAUG-3'        (SEQ ID NO: 3699)
                  3'-CUCAUGGCGUACGUGUUCAGAGCCUAC-5'      (SEQ ID NO: 3603)

AR-m2312  Target: 5'-GAGTACCGCATGCACAAGTCTCGGATG-3'      (SEQ ID NO: 3651)

5'-GUGCAUGAAAGCACUGCUGCUCUUC-3'        (SEQ ID NO: 3700)
                  3'-GACACGUACUUUCGUGACGACGAGAAG-5'      (SEQ ID NO: 3604)
```

TABLE 12-continued

AR Duplexes, Unmodified Forms of Tested Duplexes, Mouse

```
AR-m2411 Target: 5'-CTGTGCATGAAAGCACTGCTGCTCTTC-3'   (SEQ ID NO: 3652)

5'-UGAAAGCACUGCUGCUCUUCAGCAU-3'    (SEQ ID NO: 3701)
                  3'-GUACUUUCGUGACGACGAGAAGUCGUA-5'  (SEQ ID NO: 3605)

AR-m2416 Target: 5'-CATGAAAGCACTGCTGCTCTTCAGCAT-3'   (SEQ ID NO: 3653)

5'-CACUGCUGCUCUUCAGCAUUAUUCC-3'    (SEQ ID NO: 3702)
                  3'-UCGUGACGACGAGAAGUCGUAAUAAGG-5'  (SEQ ID NO: 3606)

AR-m2422 Target: 5'-AGCACTGCTGCTCTTCAGCATTATTCC-3'   (SEQ ID NO: 3654)

5'-CUGCUCUUCAGCAUUAUUCCAGUGG-3'    (SEQ ID NO: 3703)
                  3'-ACGACGAGAAGUCGUAAUAAGGUCACC-5'  (SEQ ID NO: 3607)

AR-m2427 Target: 5'-TGCTGCTCTTCAGCATTATTCCAGTGG-3'   (SEQ ID NO: 3655)

5'-CUCACCAAGCUCCUGGAUUCUGUGC-3'    (SEQ ID NO: 3704)
                  3'-UCGAGUGGUUCGAGGACCUAAGACACG-5'  (SEQ ID NO: 3608)

AR-m2571 Target: 5'-AGCTCACCAAGCTCCTGGATTCTGTGC-3'   (SEQ ID NO: 3656)

5'-CUCCUGGAUUCUGUGCAGCCUAUUG-3'    (SEQ ID NO: 3705)
                  3'-UCGAGGACCUAAGACACGUCGGAUAAC-5'  (SEQ ID NO: 3609)

AR-m2580 Target: 5'-AGCTCCTGGATTCTGTGCAGCCTATTG-3'   (SEQ ID NO: 3657)

5'-GGAUUCUGUGCAGCCUAUUGCAAGA-3'    (SEQ ID NO: 3706)
                  3'-GACCUAAGACACGUCGGAUAACGUUCU-5'  (SEQ ID NO: 3610)

AR-m2585 Target: 5'-CTGGATTCTGTGCAGCCTATTGCAAGA-3'   (SEQ ID NO: 3658)

5'-UGUGCAGCCUAUUGCAAGAGAGCUG-3'    (SEQ ID NO: 3707)
                  3'-AGACACGUCGGAUAACGUUCUCUCGAC-5'  (SEQ ID NO: 3611)

AR-m2591 Target: 5'-TCTGTGCAGCCTATTGCAAGAGAGCTG-3'   (SEQ ID NO: 3659)

5'-GCCUAUUGCAAGAGAGCUGCAUCAG-3'    (SEQ ID NO: 3708)
                  3'-GUCGGAUAACGUUCUCUCGACGUAGUC-5'  (SEQ ID NO: 3612)

AR-m2597 Target: 5'-CAGCCTATTGCAAGAGAGCTGCATCAG-3'   (SEQ ID NO: 3660)

5'-GUGGACUUUCCUGAAAUGAUGGCAG-3'    (SEQ ID NO: 3709)
                  3'-CGCACCUGAAAGGACUUUACUACCGUC-5'  (SEQ ID NO: 3613)

AR-m2661 Target: 5'-GCGTGGACTTTCCTGAAATGATGGCAG-3'   (SEQ ID NO: 3661)

5'-UUCUGCCUGUUAUAUAACUCUGCAC-3'    (SEQ ID NO: 3710)
                  3'-AGAAGACGGACAAUAUAUUGAGACGUG-5'  (SEQ ID NO: 3614)

AR-m2809 Target: 5'-TCTTCTGCCTGTTATATAACTCTGCAC-3'   (SEQ ID NO: 3662)

5'-CACUACUUCUCUGCAGUGCCUUGGG-3'    (SEQ ID NO: 3711)
                  3'-ACGUGAUGAAGAGACGUCACGGAACCC-5'  (SEQ ID NO: 3615)

AR-m2831 Target: 5'-TGCACTACTTCTCTGCAGTGCCTTGGG-3'   (SEQ ID NO: 3663)

5'-CUGGGCUUCUCCUUCUUUUUUUUUC-3'    (SEQ ID NO: 3712)
                  3'-AGGACCCGAAGAGGAAGAAAAAAAAAG-5'  (SEQ ID NO: 3616)

AR-m2912 Target: 5'-TCCTGGGCTTCTCCTTCTTTTTTTTTC-3'   (SEQ ID NO: 3664)

5'-UUCUCCUUCUUUUUUUUUCUUCUUC-3'    (SEQ ID NO: 3713)
                  3'-CGAAGAGGAAGAAAAAAAAAGAAGAAG-5'  (SEQ ID NO: 3617)

AR-m2918 Target: 5'-GCTTCTCCTTCTTTTTTTTTCTTCTTC-3'   (SEQ ID NO: 3665)

5'-CUUUUUUUUUCUUCUUCCCUCCCUC-3'    (SEQ ID NO: 3714)
                  3'-AAGAAAAAAAAGAAGAAGGGAGGGAG-5'   (SEQ ID NO: 3618)

AR-m2926 Target: 5'-TTCTTTTTTTTTCTTCTTCCCTCCCTC-3'   (SEQ ID NO: 3666)

5'-GCUGCGUAUUGUGGCUCCUGCCUUU-3'    (SEQ ID NO: 3715)
                  3'-GACGACGCAUAACACCGAGGACGGAAA-5'  (SEQ ID NO: 3619)
```

TABLE 12-continued

AR Duplexes, Unmodified Forms of Tested Duplexes, Mouse

```
AR-m2981 Target: 5'-CTGCTGCGTATTGTGGCTCCTGCCTTT-3'     (SEQ ID NO: 3667)

5'-UGGCUCCUGCCUUUGUUUUGAUUUC-3'       (SEQ ID NO: 3716)
                 3'-ACACCGAGGACGGAAACAAAACUAAAG-5'     (SEQ ID NO: 3620)

AR-m2992 Target: 5'-TGTGGCTCCTGCCTTTGTTTTGATTTC-3'     (SEQ ID NO: 3668)

5'-CCUGCCUUUGUUUUGAUUUCUGUUG-3'       (SEQ ID NO: 3717)
                 3'-GAGGACGGAAACAAAACUAAAGACAAC-5'     (SEQ ID NO: 3621)

AR-m2997 Target: 5'-CTCCTGCCTTTGTTTTGATTTCTGTTG-3'     (SEQ ID NO: 3669)
```

In this example, 456 asymmetric DsiRNAs (tested DsiRNAs possessed a 25/27mer structure) were constructed and tested for AR inhibitory efficacy in human 22Rv1 and mouse LMTK-cells incubated in the presence of such DsiRNAs at a concentration of 1 nM. The 456 asymmetric DsiRNAs tested included a subset of DsiRNAs selected from Tables 2 and 3 above, as well as a further set of asymmetric DsiRNAs designed to target specific sequences within human AR, mouse AR, or both. Sequences and structures of all 456 tested asymmetric DsiRNAs are shown above in Tables 9 and 10. As in Tables 2 and 3 above, underlined nucleotide residues of above Tables 9-12 indicate 2'-O-methyl modified residues; ribonucleotide residues are shown as UPPER CASE, while deoxyribonucleotide residues are shown as lower case.

Assay of the above 456 AR targeting DsiRNAs in human 22Rv1 and mouse LMTK-cells at 1 nM revealed the following AR inhibitory efficacies, presented in Tables 13 and 14. AR levels were determined using qPCR assays positioned at locations within the AR transcript (for human 22Rv1 cell experiments, reliable qPCR assays were those of the AR 3382-3554 amplicon (Yakima Yellow); for mouse LMTK-cell experiments, paired qPCR assays were performed and are indicated as "Mm AR 1554-1667 (FAM)" and "Mm AR 2413-2528 (Yakima Yellow)").

TABLE 13

AR Inhibitory Efficacy of DsiRNAs Assayed at 1 nM in Human 22Rv1 Cells

| Human AR Target Location (Long transcript) | Human AR Target Location (Short transcript) | Mouse AR Target Location | % Remaining AR mRNA ± % Error |
|---|---|---|---|
| AR-39 | N/A | N/A | 187.5 ± 7.2 |
| AR-174 | N/A | N/A | 71.2 ± 3.4 |
| AR-186 | N/A | N/A | 73.8 ± 5.3 |
| AR-194 | N/A | N/A | 89.1 ± 2.8 |
| AR-200 | N/A | N/A | 121.4 ± 3.8 |
| AR-216 | N/A | N/A | 135.5 ± 11.3 |
| AR-222 | N/A | N/A | 89.1 ± 10.9 |
| AR-252 | N/A | N/A | 57.9 ± 3.5 |
| AR-375 | N/A | N/A | 115.7 ± 3.8 |
| AR-387 | N/A | N/A | 66.3 ± 3.7 |
| AR-506 | N/A | N/A | 101.8 ± 4.2 |
| AR-518 | N/A | N/A | 62.1 ± 5.5 |
| AR-646 | N/A | N/A | 101.3 ± 17.9 |
| AR-689 | N/A | N/A | 37.3 ± 10.9 |
| AR-724 | N/A | N/A | 24.8 ± 7.8 |
| AR-730 | N/A | N/A | 25.9 ± 5.6 |
| AR-737 | N/A | N/A | 43.2 ± 4.7 |
| AR-752 | N/A | N/A | 50.6 ± 4 |
| AR-760 | N/A | N/A | 23.7 ± 12.1 |
| AR-770 | N/A | N/A | 23.1 ± 12.2 |
| AR-775 | N/A | N/A | 42.5 ± 9.7 |
| AR-778 | N/A | N/A | 52.8 ± 2.9 |

TABLE 13-continued

AR Inhibitory Efficacy of DsiRNAs Assayed at 1 nM in Human 22Rv1 Cells

| Human AR Target Location (Long transcript) | Human AR Target Location (Short transcript) | Mouse AR Target Location | % Remaining AR mRNA ± % Error |
|---|---|---|---|
| AR-833 | N/A | N/A | 44.9 ± 8.5 |
| AR-838 | N/A | N/A | 61.6 ± 7.4 |
| AR-844 | N/A | N/A | 62.4 ± 4.4 |
| AR-864 | N/A | N/A | 38.7 ± 19.5 |
| AR-971 | N/A | N/A | 72.9 ± 4.1 |
| AR-976 | N/A | N/A | 110.3 ± 8.1 |
| AR-1000 | N/A | N/A | 88.3 ± 15.8 |
| AR-1016 | N/A | N/A | 81.3 ± 5.3 |
| AR-1028 | N/A | N/A | 45.6 ± 4.7 |
| AR-1146 | N/A | m63 | 86.7 ± 19 |
| AR-1147 | N/A | m64 | 82.2 ± 6 |
| AR-1148 | N/A | m65 | 125.3 ± 16.7 |
| AR-1149 | N/A | m66 | 47.8 ± 12 |
| AR-1150 | N/A | m67 | 135.4 ± 15.9 |
| AR-1151 | N/A | m68 | 46.6 ± 21.7 |
| AR-1152 | N/A | m69 | 58.2 ± 5.9 |
| AR-1153 | N/A | m70 | 91.3 ± 3.8 |
| AR-1154 | N/A | m71 | 111.2 ± 11.4 |
| AR-1155 | N/A | m72 | 114.3 ± 12.7 |
| AR-1156 | N/A | m73 | 155.3 ± 22.8 |
| AR-1206 | N/A | m123 | 77.9 ± 4.8 |
| AR-1207 | N/A | m124 | 128.8 ± 20.1 |
| AR-1208 | N/A | m125 | 49.5 ± 3.8 |
| AR-1209 | N/A | m126 | 31 ± 20.3 |
| AR-1210 | N/A | m127 | 18.4 |
| AR-1211 | N/A | m128 | 36.4 ± 34.7 |
| AR-1212 | N/A | m129 | 57.1 ± 13.3 |
| AR-1213 | N/A | m130 | 69.2 ± 5.8 |
| AR-1214 | N/A | m131 | 46 ± 6.6 |
| AR-1215 | N/A | m132 | 35.7 ± 8.3 |
| AR-1216 | N/A | m133 | 21.4 ± 31 |
| AR-1217 | N/A | m134 | 25.2 ± 10.9 |
| AR-1218 | N/A | m135 | 40.8 |
| AR-1292 | N/A | N/A | 102.6 ± 12.9 |
| AR-1301 | N/A | N/A | 171 ± 6.6 |
| AR-1533 | N/A | N/A | 88.1 ± 9.7 |
| AR-1572 | N/A | N/A | 98.3 ± 5.4 |
| AR-1578 | N/A | N/A | 122.3 ± 19 |
| AR-1621 | N/A | m475 | 71.1 ± 7.9 |
| AR-1656 | N/A | m510 | 39.6 ± 17.6 |
| AR-1657 | N/A | m511 | 43.8 ± 2.2 |
| AR-1662 | N/A | N/A | 34.2 ± 8.9 |
| AR-1712 | N/A | N/A | 35.3 ± 3.8 |
| AR-1832 | N/A | N/A | 43.5 ± 7.1 |
| AR-1952 | N/A | N/A | 92.6 ± 5.8 |
| AR-2037 | N/A | N/A | 35.3 ± 5.8 |
| AR-2124 | N/A | N/A | 58.6 ± 6.1 |
| AR-2222 | N/A | m1118 | 33.2 ± 7 |
| AR-2223 | N/A | m1119 | 50 ± 14 |
| AR-2224 | N/A | m1120 | 27.9 ± 17.7 |
| AR-2294 | N/A | N/A | 127.9 ± 15.8 |
| AR-2317 | N/A | m1213 | 84.1 ± 2.4 |
| AR-2318 | N/A | m1214 | 90.4 ± 10.4 |

TABLE 13-continued

AR Inhibitory Efficacy of DsiRNAs Assayed at 1 nM in Human 22Rv1 Cells

| Human AR Target Location (Long transcript) | Human AR Target Location (Short transcript) | Mouse AR Target Location | % Remaining AR mRNA ± % Error |
|---|---|---|---|
| AR-2319 | N/A | m1215 | 96.7 ± 15.1 |
| AR-2320 | N/A | m1216 | 102.4 ± 20.8 |
| AR-2386 | N/A | N/A | 84.3 ± 9.5 |
| AR-2607 | N/A | N/A | 36.8 ± 9.8 |
| AR-2650 | N/A | N/A | 50.8 ± 5.6 |
| AR-2720 | N/A | N/A | 31 ± 6.1 |
| AR-2808 | 259 | m1662 | 19.4 ± 12.7 |
| AR-2809 | 260 | m1663 | 37.1 ± 15.4 |
| AR-2810 | 261 | m1664 | 43.5 ± 22.9 |
| AR-2811 | 262 | m1665 | 44.2 ± 8.3 |
| AR-2812 | 263 | m1666 | 30.6 ± 5.8 |
| AR-2813 | 264 | m1667 | 22.6 ± 6.5 |
| AR-2814 | 265 | m1668 | 21.9 ± 16.6 |
| AR-2815 | 266 | m1669 | 19 ± 5.8 |
| AR-2816 | 267 | m1670 | 21.7 ± 8.5 |
| AR-2817 | 268 | m1671 | 22.6 ± 7.3 |
| AR-2818 | 269 | m1672 | 29.9 ± 13.7 |
| AR-2819 | 270 | m1673 | 19.3 ± 21.6 |
| AR-2820 | 271 | m1674 | 46.3 ± 4.7 |
| AR-2821 | 272 | m1675 | 63.5 ± 10.2 |
| AR-2822 | 273 | m1676 | 80.9 ± 5.9 |
| AR-2823 | 274 | m1677 | 114.3 ± 26.6 |
| AR-2824 | 275 | m1678 | 66.4 ± 4.5 |
| AR-2825 | 276 | m1679 | 48.2 ± 9.1 |
| AR-2826 | 277 | m1680 | 51.6 ± 8.5 |
| AR-2827 | 278 | m1681 | 53.6 ± 2.7 |
| AR-2840 | 291 | N/A | 56 ± 8.7 |
| AR-2857 | 308 | N/A | 40 ± 7 |
| AR-2874 | 325 | m1728 | 20 ± 8.3 |
| AR-2875 | 326 | m1729 | 27 |
| AR-2876 | 327 | m1730 | 30.1 ± 10.2 |
| AR-2877 | 328 | m1731 | 39.1 ± 10.1 |
| AR-2878 | 329 | m1732 | 25.7 ± 34.4 |
| AR-2879 | 330 | m1733 | 33.9 ± 2.7 |
| AR-2880 | 331 | m1734 | 58.1 ± 16.3 |
| AR-2881 | 332 | m1735 | 44.3 ± 3.3 |
| AR-2882 | 333 | m1736 | 39.6 ± 6.2 |
| AR-2883 | 334 | m1737 | 45.5 ± 5 |
| AR-2884 | 335 | m1738 | 72.5 ± 7.6 |
| AR-2885 | 336 | m1739 | 39.1 ± 4.6 |
| AR-2886 | 337 | m1740 | 24.4 ± 25.8 |
| AR-2887 | 338 | m1741 | 33.6 ± 9.3 |
| AR-2888 | 339 | m1742 | 29.6 ± 8.1 |
| AR-2889 | 340 | m1743 | 39.8 ± 2.6 |
| AR-2890 | 341 | m1744 | 38.5 ± 14.4 |
| AR-2891 | 342 | m1745 | 22.5 ± 7.1 |
| AR-2892 | 343 | m1746 | 30.5 ± 8.8 |
| AR-2893 | 344 | m1747 | 33.4 ± 14.3 |
| AR-2894 | 345 | m1748 | 30 ± 7.5 |
| AR-2895 | 346 | m1749 | 45.6 ± 8.8 |
| AR-2896 | 347 | m1750 | 45.6 ± 5.1 |
| AR-2897 | 348 | m1751 | 33.6 ± 6.5 |
| AR-2898 | 349 | m1752 | 32.7 ± 7.1 |
| AR-2899 | 350 | m1753 | 26.3 ± 31.9 |
| AR-2901 | 352 | m1755 | 22.9 ± 12.5 |
| AR-2902 | 353 | m1756 | 21.8 ± 10.9 |
| AR-2923 | 374 | N/A | 14.5 ± 9.6 |
| AR-2934 | 385 | N/A | 20.3 ± 11.5 |
| AR-2939 | 390 | N/A | 26.3 ± 1.6 |
| AR-2947 | 398 | N/A | 20 ± 4.1 |
| AR-2991 | 442 | m1845 | 34.2 ± 3.8 |
| AR-2992 | 443 | m1846 | 32.2 ± 1.5 |
| AR-2993 | 444 | m1847 | 28.9 ± 6.2 |
| AR-2994 | 445 | m1848 | 42.2 ± 10.2 |
| AR-2995 | 446 | m1849 | 35.4 ± 2.8 |
| AR-2996 | 447 | m1850 | 20.9 ± 9.4 |
| AR-2997 | 448 | m1851 | 52.6 ± 8.2 |
| AR-2998 | 449 | m1852 | 29.2 ± 11.9 |
| AR-2999 | 450 | m1853 | 65.8 ± 5.9 |
| AR-3000 | 451 | m1854 | 69.2 ± 4.5 |
| AR-3001 | 452 | m1855 | 63.5 ± 6.9 |
| AR-3002 | 453 | m1856 | 82.5 ± 5.5 |
| AR-3003 | 454 | m1857 | 49.5 ± 9.9 |
| AR-3004 | 455 | m1858 | 44 ± 8.3 |
| AR-3005 | 456 | m1859 | 38.6 ± 15.6 |
| AR-3006 | 457 | m1860 | 38.8 ± 9.6 |
| AR-3007 | 458 | m1861 | 51 ± 11.8 |
| AR-3035 | 486 | N/A | 17.1 ± 2.7 |
| AR-3054 | 505 | m1908 | 44 ± 8.8 |
| AR-3055 | 506 | m1909 | 93 ± 6.9 |
| AR-3131 | 582 | m1985 | 25.7 ± 6.5 |
| AR-3132 | 583 | m1986 | 20 ± 1.4 |
| AR-3133 | 584 | m1987 | 63.8 ± 9.2 |
| AR-3134 | 585 | m1988 | 59.4 ± 8.2 |
| AR-3135 | 586 | m1989 | 58.9 ± 13.8 |
| AR-3136 | 587 | m1990 | 37.7 ± 8.6 |
| AR-3168 | 619 | m2022 | 73.6 ± 14.8 |
| AR-3169 | 620 | m2023 | 44.8 ± 9.4 |
| AR-3170 | 621 | m2024 | 52 ± 5.4 |
| AR-3171 | 622 | m2025 | 37.9 ± 5.7 |
| AR-3172 | 623 | m2026 | 59.1 ± 8.4 |
| AR-3219 | 670 | N/A | 44.1 ± 6.9 |
| AR-3225 | 676 | N/A | 40.1 ± 1.5 |
| AR-3235 | 686 | N/A | 23.8 ± 6 |
| AR-3285 | 736 | m2139 | 95.3 ± 5.5 |
| AR-3286 | 737 | m2140 | 105.6 ± 10.3 |
| AR-3287 | 738 | m2141 | 54.9 ± 5.4 |
| AR-3288 | 739 | m2142 | 54.3 ± 5 |
| AR-3289 | 740 | m2143 | 92.8 ± 16.8 |
| AR-3290 | 741 | m2144 | 83.7 ± 15.1 |
| AR-3291 | 742 | m2145 | 76.9 ± 7.7 |
| AR-3292 | 743 | m2146 | 123.7 ± 15.5 |
| AR-3293 | 744 | m2147 | 137.7 ± 15.7 |
| AR-3294 | 745 | m2148 | 137.2 ± 5.8 |
| AR-3295 | 746 | m2149 | 105.7 ± 4.7 |
| AR-3296 | 747 | m2150 | 131.1 ± 9.4 |
| AR-3297 | 748 | m2151 | 83.5 ± 4.4 |
| AR-3298 | 749 | m2152 | 104.2 ± 0.5 |
| AR-3299 | 750 | m2153 | 81.8 ± 2.2 |
| AR-3300 | 751 | m2154 | 50.1 ± 16.5 |
| AR-3301 | 752 | m2155 | 52.7 ± 5.8 |
| AR-3302 | 753 | m2156 | 53.4 ± 11.7 |
| AR-3303 | 754 | m2157 | 49 ± 15.6 |
| AR-3304 | 755 | m2158 | 82.9 ± 13.3 |
| AR-3305 | 756 | m2159 | 24.3 ± 18.6 |
| AR-3306 | 757 | m2160 | 37.7 ± 10.7 |
| AR-3307 | 758 | m2161 | 36.7 ± 5 |
| AR-3408 | 859 | m2262 | 17.2 ± 10.4 |
| AR-3409 | 860 | m2263 | 22.7 ± 6.7 |
| AR-3410 | 861 | m2264 | 19.7 ± 9 |
| AR-3411 | 862 | m2265 | 15.9 ± 5.3 |
| AR-3412 | 863 | m2266 | 42.2 ± 11.3 |
| AR-3413 | 864 | m2267 | 23.6 ± 24.5 |
| AR-3414 | 865 | m2268 | 17.9 ± 11.7 |
| AR-3445 | 896 | m2299 | 18.7 ± 3.7 |
| AR-3446 | 897 | m2300 | 22.4 ± 7.4 |
| AR-3447 | 898 | m2301 | 19 ± 9.6 |
| AR-3448 | 899 | m2302 | 60.5 ± 3.2 |
| AR-3449 | 900 | m2303 | 61.8 ± 9.6 |
| AR-3450 | 901 | m2304 | 75.3 ± 9 |
| AR-3451 | 902 | m2305 | 33.4 ± 6.7 |
| AR-3452 | 903 | m2306 | 24.9 ± 6.9 |
| AR-3453 | 904 | m2307 | 52.5 |
| AR-3454 | 905 | m2308 | 91.5 ± 11.6 |
| AR-3455 | 906 | m2309 | 60.6 ± 12.7 |
| AR-3456 | 907 | m2310 | 28.3 ± 2.5 |
| AR-3457 | 908 | m2311 | 24.9 ± 8.6 |
| AR-3513 | 964 | m2367 | 30.2 ± 20.7 |
| AR-3514 | 965 | m2368 | 17.1 ± 9.9 |
| AR-3515 | 966 | m2369 | 28.5 ± 10 |
| AR-3516 | 967 | m2370 | 23.8 ± 1.9 |
| AR-3517 | 968 | m2371 | 10.7 ± 2.6 |
| AR-3518 | 969 | m2372 | 9.1 ± 7.5 |
| AR-3519 | 970 | m2373 | 15.3 ± 8.6 |
| AR-3546 | 997 | m2400 | 16.8 ± 5.4 |
| AR-3547 | 998 | m2401 | 20.7 ± 5.8 |

TABLE 13-continued

AR Inhibitory Efficacy of DsiRNAs Assayed at 1 nM in Human 22Rv1 Cells

| Human AR Target Location (Long transcript) | Human AR Target Location (Short transcript) | Mouse AR Target Location | % Remaining AR mRNA ± % Error |
|---|---|---|---|
| AR-3548 | 999 | m2402 | 15.4 ± 4.4 |
| AR-3549 | 1000 | m2403 | 32 ± 2.9 |
| AR-3550 | 1001 | m2404 | 49.8 ± 9.7 |
| AR-3551 | 1002 | m2405 | 39 ± 9 |
| AR-3552 | 1003 | m2406 | 74.5 ± 9.5 |
| AR-3553 | 1004 | m2407 | 33.8 ± 8.6 |
| AR-3554 | 1005 | m2408 | 24.7 ± 18.7 |
| AR-3555 | 1006 | m2409 | 20.5 ± 4.9 |
| AR-3556 | 1007 | m2410 | 19 ± 5.7 |
| AR-3576 | 1027 | m2430 | 16.8 ± 10.1 |
| AR-3577 | 1028 | m2431 | 48 ± 9.8 |
| AR-3578 | 1029 | m2432 | 15.7 ± 8.8 |
| AR-3579 | 1030 | m2433 | 16.9 ± 8.2 |
| AR-3580 | 1031 | m2434 | 18.5 ± 29 |
| AR-3581 | 1032 | m2435 | 18.5 ± 3.1 |
| AR-3582 | 1033 | m2436 | 27.2 ± 22.5 |
| AR-3583 | 1034 | m2437 | 27.4 ± 4.2 |
| AR-3584 | 1035 | m2438 | 40.9 ± 7.7 |
| AR-3585 | 1036 | m2439 | 32.5 ± 5.4 |
| AR-3586 | 1037 | m2440 | 24.5 ± 6.1 |
| AR-3587 | 1038 | m2441 | 27.4 ± 7.8 |
| AR-3588 | 1039 | m2442 | 24 ± 9.4 |
| AR-3589 | 1040 | m2443 | 14.3 ± 5.8 |
| AR-3590 | 1041 | m2444 | 16.6 ± 10.8 |
| AR-3591 | 1042 | m2445 | 12.2 ± 19.2 |
| AR-3592 | 1043 | m2446 | 18.4 ± 7.2 |
| AR-3593 | 1044 | m2447 | 24.9 ± 7.4 |
| AR-3594 | 1045 | m2448 | 17.5 ± 61.1 |
| AR-3595 | 1046 | m2449 | 35.5 ± 8 |
| AR-3596 | 1047 | m2450 | 25.3 ± 12.2 |
| AR-3597 | 1048 | m2451 | 16 ± 15 |
| AR-3598 | 1049 | m2452 | 14.5 ± 18.5 |
| AR-3599 | 1050 | m2453 | 23.1 ± 17.6 |
| AR-3599 | 1050 | m2453 | 14.3 ± 1.5 |
| AR-3600 | 1051 | m2454 | 17.1 ± 7.6 |
| AR-3601 | 1052 | m2455 | 19.2 |
| AR-3602 | 1053 | m2456 | 27.8 ± 7.6 |
| AR-3603 | 1054 | m2457 | 30.7 ± 6.7 |
| AR-3604 | 1055 | m2458 | 49.7 ± 4.7 |
| AR-3604 | 1055 | m2458 | 33.8 ± 4.2 |
| AR-3605 | 1056 | m2459 | 21 ± 23.6 |
| AR-3606 | 1057 | m2460 | 76 ± 5.2 |
| AR-3608 | 1059 | m2462 | 29.2 ± 7.6 |
| AR-3608 | 1059 | m2462 | 29.4 ± 6.2 |
| AR-3609 | 1060 | m2463 | 36.7 ± 18.5 |
| AR-3610 | 1061 | m2464 | 26.2 ± 25.1 |
| AR-3611 | 1062 | m2465 | 29.3 ± 12.3 |
| AR-3612 | 1063 | m2466 | 15.2 ± 7.6 |
| AR-3613 | 1064 | m2467 | 18.6 ± 16.1 |
| AR-3614 | 1065 | m2468 | 30.6 ± 10.8 |
| AR-3615 | 1066 | m2469 | 14.4 ± 22.3 |
| AR-3616 | 1067 | m2470 | 12.3 ± 13.2 |
| AR-3617 | 1068 | m2471 | 11.8 ± 4.8 |
| AR-3618 | 1069 | m2472 | 20 ± 3 |
| AR-3619 | 1070 | m2473 | 34 ± 3.9 |
| AR-3620 | 1071 | m2474 | 23.3 ± 12.7 |
| AR-3621 | 1072 | m2475 | 20.9 ± 4 |
| AR-3622 | 1073 | m2476 | 36.7 ± 21 |
| AR-3623 | 1074 | m2477 | 57.7 ± 12.1 |
| AR-3624 | 1075 | m2478 | 20.1 ± 7 |
| AR-3625 | 1076 | m2479 | 24.7 ± 19.2 |
| AR-3626 | 1077 | m2480 | 28.9 ± 5.6 |
| AR-3627 | 1078 | m2481 | 47.8 ± 15.1 |
| AR-3628 | 1079 | m2482 | 40.8 ± 15.5 |
| AR-3629 | 1080 | m2483 | 37.9 ± 8.7 |
| AR-3630 | 1081 | m2484 | 32.5 ± 8.2 |
| AR-3631 | 1082 | m2485 | 66.1 ± 11.2 |
| AR-3632 | 1083 | m2486 | 31.4 ± 4.7 |
| AR-3633 | 1084 | m2487 | 25.8 ± 8.3 |
| AR-3634 | 1085 | m2488 | 27.2 ± 14.1 |
| AR-3635 | 1086 | m2489 | 30 ± 16.8 |
| AR-3636 | 1087 | m2490 | 32.1 ± 9.4 |
| AR-3637 | 1088 | m2491 | 36.7 ± 10.3 |
| AR-3638 | 1089 | m2492 | 21.6 ± 10.5 |
| AR-3639 | 1090 | m2493 | 20.6 ± 20.5 |
| AR-3640 | 1091 | m2494 | 14.5 ± 10.7 |
| AR-3641 | 1092 | m2495 | 12.9 ± 14.8 |
| AR-3642 | 1093 | m2496 | 20.1 ± 33.9 |
| AR-3643 | 1094 | m2497 | 55.3 ± 16.9 |
| AR-3663 | 1114 | m2517 | 22.4 ± 48.3 |
| AR-3664 | 1115 | m2518 | 20 ± 36.3 |
| AR-3684 | 1135 | m2538 | 97.6 ± 60 |
| AR-3685 | 1136 | m2539 | 21.8 ± 33.4 |
| AR-3705 | 1156 | m2559 | 34.3 ± 30.6 |
| AR-3706 | 1157 | m2560 | 27.3 ± 54.4 |
| AR-3707 | 1158 | m2561 | 47.3 ± 54.1 |
| AR-3708 | 1159 | m2562 | 120.2 ± 28.4 |
| AR-3709 | 1160 | m2563 | 69 ± 29.8 |
| AR-3710 | 1161 | m2564 | 56.4 ± 18.2 |
| AR-3711 | 1162 | m2565 | 137.6 ± 47.3 |
| AR-3712 | 1163 | m2566 | 39.5 ± 32.8 |
| AR-3713 | 1164 | m2567 | 76.5 ± 7.1 |
| AR-3714 | 1165 | m2568 | 58.3 ± 14 |
| AR-3715 | 1166 | m2569 | 35.4 ± 31.7 |
| AR-3717 | 1168 | N/A | 42.7 ± 13.7 |
| AR-3726 | 1177 | N/A | 49.6 ± 7.5 |
| AR-3737 | 1188 | N/A | 27.3 ± 15.2 |
| AR-3753 | 1204 | m2607 | 56.6 ± 27 |
| AR-3754 | 1205 | m2608 | 49.9 ± 36.2 |
| AR-3755 | 1206 | m2609 | 38.5 ± 30 |
| AR-3756 | 1207 | m2610 | 72.6 ± 15.5 |
| AR-3757 | 1208 | m2611 | 33.9 ± 16.3 |
| AR-3758 | 1209 | m2612 | 32.3 ± 18.4 |
| AR-3759 | 1210 | m2613 | 16.7 ± 10.9 |
| AR-3760 | 1211 | m2614 | 28.2 ± 4.9 |
| AR-3761 | 1212 | m2615 | 27.9 ± 11.8 |
| AR-3762 | 1213 | m2616 | 18.4 ± 6.6 |
| AR-3763 | 1214 | m2617 | 24.5 ± 6.4 |
| AR-3764 | 1215 | m2618 | 38.7 ± 10.1 |
| AR-3765 | 1216 | m2619 | 21.3 ± 2.1 |
| AR-3766 | 1217 | m2620 | 21.5 ± 7.3 |
| AR-3767 | 1218 | m2621 | 14.3 ± 3.7 |
| AR-3768 | 1219 | m2622 | 22.9 ± 10.9 |
| AR-3769 | 1220 | m2623 | 23 ± 17.8 |
| AR-3770 | 1221 | m2624 | 17.4 ± 5.2 |
| AR-3771 | 1222 | m2625 | 17.6 ± 5.2 |
| AR-3772 | 1223 | m2626 | 31.1 ± 16.2 |
| AR-3773 | 1224 | m2627 | 36.6 ± 14.8 |
| AR-3798 | 1249 | m2652 | 31.3 ± 7.6 |
| AR-3799 | 1250 | m2653 | 28 ± 6.5 |
| AR-3819 | 1270 | m2673 | 27.3 ± 7.4 |
| AR-3820 | 1271 | m2674 | 51.5 ± 2.2 |
| AR-3821 | 1272 | m2675 | 59.7 ± 3.9 |
| AR-3822 | 1273 | m2676 | 59.9 ± 2.2 |
| AR-3823 | 1274 | m2677 | 91.5 ± 4.3 |
| AR-3824 | 1275 | m2678 | 20.4 ± 5.8 |
| AR-3825 | 1276 | m2679 | 28 ± 17.5 |
| AR-3826 | 1277 | m2680 | 19.1 ± 7.2 |
| AR-3827 | 1278 | m2681 | 24.8 ± 15.1 |
| AR-3828 | 1279 | m2682 | 32.1 ± 13 |
| AR-3829 | 1280 | m2683 | 28.9 ± 4.5 |
| AR-3830 | 1281 | m2684 | 24.8 ± 4.1 |
| AR-3831 | 1282 | m2685 | 19.4 ± 5.2 |
| AR-3832 | 1283 | m2686 | 30.7 ± 3.2 |
| AR-3833 | 1284 | m2687 | 52.2 ± 5.7 |
| AR-3834 | 1285 | m2688 | 60.5 |
| AR-3835 | 1286 | m2689 | 38.2 ± 6 |
| AR-3836 | 1287 | m2690 | 22.4 ± 12.8 |
| AR-3837 | 1288 | m2691 | 17.3 ± 5.2 |
| AR-3838 | 1289 | m2692 | 27.1 ± 3.8 |
| AR-3839 | 1290 | m2693 | 21.8 ± 6 |
| AR-3840 | 1291 | m2694 | 37.3 ± 8.1 |
| AR-3841 | 1292 | m2695 | 25.4 ± 10.3 |
| AR-3842 | 1293 | m2696 | 45.3 ± 4.2 |
| AR-3843 | 1294 | m2697 | 23.8 ± 6 |
| AR-3844 | 1295 | m2698 | 20.8 ± 11.4 |

TABLE 13-continued

AR Inhibitory Efficacy of DsiRNAs Assayed at 1 nM in Human 22Rv1 Cells

| Human AR Target Location (Long transcript) | Human AR Target Location (Short transcript) | Mouse AR Target Location | % Remaining AR mRNA ± % Error |
|---|---|---|---|
| AR-3845 | 1296 | m2699 | 23.4 ± 9.3 |
| AR-3846 | 1297 | m2700 | 31.1 ± 10.2 |
| AR-3847 | 1298 | m2701 | 32 ± 7.9 |
| AR-3848 | 1299 | m2702 | 38.7 ± 14 |
| AR-3849 | 1300 | m2703 | 43.5 ± 10.7 |
| AR-3850 | 1301 | m2704 | 43.4 ± 7.7 |
| AR-3851 | 1302 | m2705 | 29.7 ± 12.2 |
| AR-3852 | 1303 | m2706 | 25.5 ± 15.7 |
| AR-3853 | 1304 | m2707 | 16.4 ± 9.8 |
| AR-3854 | 1305 | m2708 | 49.8 ± 6.4 |
| AR-3855 | 1306 | m2709 | 30.5 ± 9.9 |
| AR-3856 | 1307 | m2710 | 36.8 ± 3.4 |
| AR-3857 | 1308 | m2711 | 32.9 ± 12.2 |
| AR-3858 | 1309 | m2712 | N/A |
| AR-3859 | 1310 | m2713 | 52.1 ± 8.3 |
| AR-3860 | 1311 | m2714 | 49.7 ± 7.8 |
| AR-3861 | 1312 | m2715 | 50.2 ± 4.7 |
| AR-3862 | 1313 | m2716 | 35.9 ± 3.9 |
| AR-3863 | 1314 | m2717 | 35.4 ± 6.6 |
| AR-3864 | 1315 | m2718 | 27.5 ± 5 |
| AR-3865 | 1316 | m2719 | 25.4 ± 9.1 |
| AR-3866 | 1317 | m2720 | 25.7 ± 6.7 |
| AR-3867 | 1318 | m2721 | 17.6 ± 13.1 |
| AR-3868 | 1319 | m2722 | 17.2 ± 9.1 |
| AR-3869 | 1320 | m2723 | 10.7 ± 8.1 |
| AR-3870 | 1321 | m2724 | 19.9 ± 5 |
| AR-3871 | 1322 | m2725 | 19.3 ± 4.4 |
| AR-3947 | 1398 | m2801 | 34.8 ± 18.7 |
| AR-3948 | 1399 | m2802 | 20.3 ± 8.8 |
| AR-3949 | 1400 | m2803 | 28 ± 4.5 |
| AR-3950 | 1401 | m2804 | 32.4 ± 6.8 |
| AR-3999 | 1450 | N/A | 47.7 ± 5.2 |
| AR-4054 | 1505 | N/A | 44.9 ± 5.3 |
| AR-4055 | 1506 | N/A | 41.6 ± 3.7 |
| AR-4061 | 1512 | N/A | 85.5 ± 5.8 |
| AR-4066 | 1517 | N/A | 83.8 ± 5.1 |
| AR-4086 | 1537 | m2931 | 54.8 ± 13.7 |
| AR-4174 | 1625 | N/A | 41 ± 4.7 |
| AR-4225 | 1676 | N/A | 35.7 ± 23.8 |
| AR-4293 | 1744 | N/A | 39.1 ± 4.4 |
| AR-4313 | 1764 | N/A | 31.7 ± 3.5 |

TABLE 14

AR Inhibitory Efficacy of DsiRNAs Assayed at 1 nM in Mouse LMTK-Cells

| Human AR Target Location (Long transcript) | Human AR Target (Short transcript) | Mouse AR Target Location | % Remaining AR mRNA ± % Error | |
|---|---|---|---|---|
| | | | Mm AR 1554-1667 (FAM) | Mm AR 2413-2528 (Yakima Yellow) |
| AR-1146 | | m63 | 116.2 ± 5.8 | 146.4 ± 5.2 |
| AR-1147 | | m64 | 143.8 ± 8.4 | 122.2 ± 2.6 |
| AR-1148 | | m65 | 142.2 ± 6.1 | 142 ± 4.8 |
| AR-1149 | | m66 | 83.3 ± 2.8 | 106.6 ± 4.7 |
| AR-1150 | | m67 | 97.2 ± 2.6 | 144.8 ± 5.4 |
| AR-1151 | | m68 | 130.1 ± 5.4 | 155 ± 4.9 |
| AR-1152 | | m69 | 115.6 ± 4.2 | 158.8 ± 3.0 |
| AR-1153 | | m70 | N/A | N/A |
| AR-1154 | | m71 | 109.7 ± 6.0 | 143.7 ± 4.2 |
| AR-1155 | | m72 | 123.4 ± 2.6 | 128.5 ± 4.4 |
| AR-1156 | | m73 | 136.4 ± 4.1 | 137.4 ± 1.7 |
| AR-1206 | | m123 | 87.3 ± 7.5 | 115.7 ± 4.1 |
| AR-1207 | | m124 | 69.9 ± 2.8 | 114 ± 5.1 |
| AR-2822 | 273 | m1676 | 94.6 ± 2.2 | 90.1 ± 7.3 |
| AR-2823 | 274 | m1677 | 105.2 ± 2.3 | 174.6 ± 44.6 |
| AR-2824 | 275 | m1678 | 95.3 ± 17.1 | 92.7 ± 17.7 |
| AR-2825 | 276 | m1679 | 96.8 ± 6.9 | 81.6 ± 10.3 |
| AR-2826 | 277 | m1680 | 111.5 ± 12.5 | 102.2 ± 16.1 |
| AR-2827 | 278 | m1681 | 115.1 ± 9.8 | 106.1 ± 7.3 |
| | | AR-m1694 | 101.3 ± 2.9 | 89.8 ± 2.4 |
| | | AR-m1711 | 69.8 ± 2.4 | 90.7 ± 4.4 |
| | | AR-m1720 | 69.1 ± 3.7 | 63.1 ± 3.1 |
| | | AR-m1725 | 38.5 ± 12.6 | 30.7 ± 1.2 |
| AR-2874 | 325 | m1728 | 40.4 ± 14.4 | 31.7 ± 6.6 |
| AR-2875 | 326 | m1729 | 58.2 | 48.2 |
| AR-2876 | 327 | m1730 | 33.2 ± 2.9 | 29.6 ± 15 |
| AR-2877 | 328 | m1731 | 82.7 ± 16.1 | 73.3 ± 13.3 |
| AR-2878 | 329 | m1732 | 62.6 ± 6.2 | 60 ± 6.5 |
| AR-2879 | 330 | m1733 | 37.5 ± 7.6 | 33.6 ± 2.9 |
| AR-2880 | 331 | m1734 | 87.7 ± 10.1 | 88.2 ± 10.2 |
| AR-2881 | 332 | m1735 | 33.9 ± 7.9 | 38.7 ± 5.0 |
| AR-2882 | 333 | m1736 | 27.6 ± 13.1 | 46.8 ± 6.4 |
| AR-2883 | 334 | m1737 | 51.7 ± 9.0 | 53.3 ± 7.6 |
| AR-2884 | 335 | m1738 | 105.9 ± 44.3 | 117.2 ± 41.5 |
| AR-2885 | 336 | m1739 | 40.2 ± 7.0 | 47.9 ± 3.7 |
| AR-2886 | 337 | m1740 | 21.1 ± 12.2 | 32.3 ± 12.1 |
| AR-2887 | 338 | m1741 | 21.5 ± 12.5 | 34.8 ± 6.5 |
| AR-2888 | 339 | m1742 | 38 ± 12.0 | 40.2 ± 14.0 |
| AR-2889 | 340 | m1743 | 47.9 ± 9.8 | 46.1 ± 10.3 |
| AR-2890 | 341 | m1744 | 41.8 ± 14.3 | 41.5 ± 13.8 |
| AR-2891 | 342 | m1745 | 23.1 | 14.6 |
| AR-2892 | 343 | m1746 | 24.7 ± 13.7 | 22.3 ± 9.9 |
| AR-2893 | 344 | m1747 | 21.3 ± 3.2 | 18.6 ± 9.1 |
| AR-2894 | 345 | m1748 | 31.8 ± 4.3 | 31.9 ± 6.9 |
| AR-2895 | 346 | m1749 | 27.1 ± 12.7 | 23.4 ± 11.4 |
| AR-2896 | 347 | m1750 | 26 | 25.7 |
| AR-2897 | 348 | m1751 | 16.8 ± 18.7 | 15.1 ± 13.8 |
| AR-2898 | 349 | m1752 | 23.8 ± 7.1 | 22.5 ± 9.1 |
| AR-2899 | 350 | m1753 | 32.2 ± 4.0 | 28.8 ± 0.9 |
| AR-2901 | 352 | m1755 | 26.8 ± 9.3 | 23.5 ± 4.8 |
| AR-2902 | 353 | m1756 | 25.4 ± 5.2 | 23 ± 3.0 |
| AR-2991 | 442 | m1845 | 38.5 ± 8.8 | 34.3 ± 7.3 |
| AR-2992 | 443 | m1846 | 43.4 ± 27.9 | 45.6 ± 34.3 |
| AR-2993 | 444 | m1847 | 39.7 ± 12.4 | 44.2 ± 12.6 |
| AR-2994 | 445 | m1848 | 39.2 ± 6.0 | 39 ± 1.8 |
| AR-2995 | 446 | m1849 | 45.6 ± 7.0 | 43.2 ± 8.9 |
| AR-2996 | 447 | m1850 | 27.3 ± 4.1 | 24.9 ± 1.8 |
| AR-2997 | 448 | m1851 | 71.3 ± 8.9 | 74.8 ± 5.5 |
| AR-2998 | 449 | m1852 | 57.6 ± 10.5 | 59.5 ± 5.7 |
| AR-2999 | 450 | m1853 | 104.3 ± 9.6 | 91.7 ± 13.1 |
| AR-3000 | 451 | m1854 | N/A | N/A |
| AR-3001 | 452 | m1855 | 63.4 ± 12.1 | 72.3 ± 17.5 |
| AR-3002 | 453 | m1856 | 85.9 ± 4.6 | 82.8 ± 2.9 |
| AR-3003 | 454 | m1857 | 80.9 ± 6.3 | 82.3 ± 7.7 |
| AR-3004 | 455 | m1858 | 75.9 ± 8.3 | 75.7 ± 9.5 |
| AR-3005 | 456 | m1859 | 67.5 ± 7.8 | 60.9 ± 9.5 |
| AR-3006 | 457 | m1860 | 60.3 ± 6.4 | 62.3 ± 9.1 |
| AR-3007 | 458 | m1861 | 107 ± 5.7 | 95.7 ± 7.2 |
| | | AR-m1865 | 41.8 ± 1.6 | 40.7 ± 2.4 |
| | | AR-m1874 | 26.3 ± 2.0 | 21.1 ± 4.3 |
| AR-3054 | 505 | m1908 | 44.6 ± 4.6 | 29.7 ± 8.5 |
| AR-3055 | 506 | m1909 | 48.7 ± 3.7 | 45 ± 1.7 |
| AR-3131 | 582 | m1985 | 35.5 ± 8.0 | 26.3 ± 8.3 |
| AR-3132 | 583 | m1986 | 40.2 | 33.6 |
| AR-3133 | 584 | m1987 | 99.2 ± 7.5 | 98.6 ± 8.0 |
| AR-3134 | 585 | m1988 | 136 ± 12.9 | 128.5 ± 12.9 |
| AR-3135 | 586 | m1989 | 79.5 ± 7.0 | 81.5 ± 4.1 |
| AR-3136 | 587 | m1990 | 62 ± 3.5 | 55.9 ± 1.5 |
| AR-3168 | 619 | m2022 | 94.7 ± 17.8 | 75.7 ± 22.6 |
| AR-3169 | 620 | m2023 | 38.3 ± 5.7 | 36.6 ± 5.1 |
| AR-3170 | 621 | m2024 | 104.2 ± 7.0 | 92.8 ± 5.1 |
| AR-3171 | 622 | m2025 | 81.3 ± 3.9 | 77 ± 4.0 |

TABLE 14-continued

AR Inhibitory Efficacy of DsiRNAs Assayed at 1 nM in Mouse LMTK-Cells

| Human AR Target Location (Long transcript) | Human AR Target (Short transcript) | Mouse AR Target Location | Mm AR 1554-1667 (FAM) | Mm AR 2413-2528 (Yakima Yellow) |
|---|---|---|---|---|
| AR-3172 | 623 | m2026 | 129 ± 5.6 | 128.6 ± 9.6 |
| | | AR-m2079 | 24.7 ± 15.8 | 16.9 ± 2.3 |
| | | AR-m2086 | 43.2 ± 7.3 | 45.1 ± 4.3 |
| AR-3285 | 736 | m2139 | 97.8 ± 8.1 | 97.4 ± 5.5 |
| AR-3286 | 737 | m2140 | 93.5 ± 5.1 | 86 ± 2.4 |
| AR-3287 | 738 | m2141 | 106.5 ± 10.5 | 96.4 ± 9.5 |
| AR-3288 | 739 | m2142 | 73.2 ± 2.9 | 53.6 ± 2.4 |
| AR-3289 | 740 | m2143 | 87.1 ± 8.1 | 94.8 ± 8.2 |
| AR-3290 | 741 | m2144 | 130.9 ± 4.5 | 125 ± 6.9 |
| AR-3291 | 742 | m2145 | 68.9 ± 7.3 | 67.5 ± 7.3 |
| AR-3292 | 743 | m2146 | 156.4 ± 15 | 165.4 ± 13.0 |
| AR-3293 | 744 | m2147 | 132.7 ± 6.8 | 130.6 ± 4.9 |
| AR-3294 | 745 | m2148 | 125.5 ± 8.9 | 130.7 ± 5.6 |
| AR-3295 | 746 | m2149 | 127.7 ± 8.0 | 118.6 ± 11.9 |
| AR-3296 | 747 | m2150 | 148.5 ± 11.1 | 116 ± 9.5 |
| AR-3297 | 748 | m2151 | 92 ± 5.9 | 96.5 ± 8.5 |
| AR-3298 | 749 | m2152 | 89.3 ± 6.6 | 84.8 ± 6.1 |
| AR-3299 | 750 | m2153 | 97.1 | 96.4 |
| AR-3300 | 751 | m2154 | 77.6 ± 10.8 | 82.9 ± 13.4 |
| AR-3301 | 752 | m2155 | 88.1 ± 4.2 | 88.7 ± 4.6 |
| AR-3302 | 753 | m2156 | 58.5 ± 6.0 | 55.8 ± 2.9 |
| AR-3303 | 754 | m2157 | 56 ± 6.6 | 50.5 ± 5.9 |
| AR-3304 | 755 | m2158 | 92.7 ± 17.0 | 65.6 ± 18.3 |
| AR-3305 | 756 | m2159 | 61.5 ± 18.9 | 55.1 ± 19.2 |
| AR-3306 | 757 | m2160 | 34.4 ± 4.6 | 30.2 ± 6.3 |
| AR-3307 | 758 | m2161 | 24.1 ± 9.3 | 17.6 ± 12.2 |
| | | AR-m2162 | 29.8 ± 5.1 | 23.4 ± 6.1 |
| | | AR-m2219 | 56.7 ± 9.8 | 49.9 ± 8.0 |
| AR-3408 | 859 | m2262 | 59.3 ± 8.3 | 57.8 ± 8.2 |
| AR-3409 | 860 | m2263 | 56.9 ± 8.2 | 55.1 ± 7.4 |
| AR-3410 | 861 | m2264 | 49.7 ± 6.4 | 48.6 ± 6.5 |
| AR-3411 | 862 | m2265 | 49 ± 6.5 | 43.7 ± 7.5 |
| AR-3412 | 863 | m2266 | 83 ± 10.0 | 59.8 ± 6.1 |
| AR-3413 | 864 | m2267 | 57.2 ± 12.2 | 56.9 ± 15.4 |
| AR-3414 | 865 | m2268 | 30 ± 3.0 | 22.6 ± 1.9 |
| | | AR-m2275 | 25.2 ± 8.4 | 24.9 ± 16.6 |
| | | AR-m2280 | 34 ± 6.4 | 25.4 ± 2.7 |
| | | AR-m2287 | 25.4 ± 5.3 | 21 ± 2.3 |
| | | AR-m2297 | 46.6 ± 11.8 | 48.4 ± 25.8 |
| AR-3445 | 896 | m2299 | 20 | 30.5 |
| AR-3446 | 897 | m2300 | 34.6 ± 10.7 | 53.4 ± 7.8 |
| AR-3447 | 898 | m2301 | 38.1 ± 17.3 | 39.5 ± 17.6 |
| AR-3448 | 899 | m2302 | 131.4 ± 18.5 | 112.1 ± 17.5 |
| AR-3449 | 900 | m2303 | 97.8 ± 13.0 | 105.8 ± 13.9 |
| AR-3450 | 901 | m2304 | 180.3 ± 7.3 | 106.6 ± 5.1 |
| AR-3451 | 902 | m2305 | 55.6 ± 12.5 | 61.3 ± 7.1 |
| AR-3452 | 903 | m2306 | 32.9 ± 1.5 | 27.4 ± 3.1 |
| AR-3453 | 904 | m2307 | 57.6 | 63 |
| AR-3454 | 905 | m2308 | 139.7 ± 12.5 | 135.6 ± 8.9 |
| AR-3455 | 906 | m2309 | 99.9 ± 6.6 | 101.5 ± 5.1 |
| AR-3456 | 907 | m2310 | 106.5 ± 5.7 | 88.1 ± 8.0 |
| AR-3457 | 908 | m2311 | 59.5 ± 27.7 | 59.6 ± 24.7 |
| | | AR-m2312 | 78.1 ± 13.0 | 72.5 ± 6.2 |
| AR-3513 | 964 | m2367 | 48.1 ± 20.0 | 42 ± 21.2 |
| AR-3514 | 965 | m2368 | 35.4 ± 11.3 | 37.9 ± 14.7 |
| AR-3515 | 966 | m2369 | 40.6 ± 23.6 | 55.5 ± 18.9 |
| AR-3516 | 967 | m2370 | 27.5 | 47.1 |
| AR-3517 | 968 | m2371 | 30.4 ± 16.2 | 62.3 ± 12.7 |
| AR-3518 | 969 | m2372 | 21.2 ± 13.7 | 21 ± 11.3 |
| AR-3519 | 970 | m2373 | 39.4 ± 16.3 | 33.7 ± 15.9 |
| AR-3546 | 997 | m2400 | 64.4 ± 22.3 | 50.9 ± 20.7 |
| AR-3547 | 998 | m2401 | 56.9 ± 11.8 | 27.3 ± 14.3 |
| AR-3548 | 999 | m2402 | 36.8 ± 9.0 | 33.6 ± 15.1 |
| AR-3549 | 1000 | m2403 | 71.3 ± 12.6 | 70.8 ± 8.6 |
| AR-3550 | 1001 | m2404 | 65.3 | 60 |
| AR-3551 | 1002 | m2405 | 61.9 ± 7.0 | 76.1 ± 8.7 |
| AR-3552 | 1003 | m2406 | 116.8 ± 1.8 | 129.7 ± 5.6 |
| AR-3553 | 1004 | m2407 | 101.6 ± 4.7 | 90.3 ± 7.3 |
| AR-3554 | 1005 | m2408 | 79.6 ± 7.4 | 71.4 ± 9.3 |
| AR-3555 | 1006 | m2409 | 31.2 ± 10.4 | 21.8 ± 7.3 |
| AR-3556 | 1007 | m2410 | 24.5 ± 3.0 | 24.7 ± 5.8 |
| | | AR-m2411 | 45.5 ± 13.7 | 37.2 ± 8.8 |
| | | AR-m2416 | 55.7 ± 5.4 | 47.9 ± 2.7 |
| | | AR-m2422 | 40.5 ± 6.2 | 27.2 ± 2.3 |
| | | AR-m2427 | 42 ± 3.0 | 40 ± 7.1 |
| AR-3576 | 1027 | m2430 | 39.3 ± 7.0 | 30.3 ± 3.6 |
| AR-3577 | 1028 | m2431 | 73.6 ± 5.3 | 83.7 ± 2.4 |
| AR-3578 | 1029 | m2432 | 39.6 ± 15.5 | 33.5 ± 11.7 |
| AR-3579 | 1030 | m2433 | 27.9 ± 10.3 | 19.3 ± 12.3 |
| AR-3580 | 1031 | m2434 | 60.2 ± 4.9 | 44.6 ± 4.3 |
| AR-3581 | 1032 | m2435 | 50 ± 1.9 | 44.1 ± 2.3 |
| AR-3582 | 1033 | m2436 | 49 ± 13.4 | 30.7 ± 11.9 |
| AR-3583 | 1034 | m2437 | 53.4 ± 7.5 | 53.2 ± 4.4 |
| AR-3584 | 1035 | m2438 | 38.1 ± 8.3 | 29.4 ± 7.1 |
| AR-3585 | 1036 | m2439 | 25.9 ± 6.8 | 18 ± 9.6 |
| AR-3586 | 1037 | m2440 | 29.7 ± 6.9 | 24.8 ± 8.1 |
| AR-3587 | 1038 | m2441 | 26 ± 5.6 | 22.5 ± 8.4 |
| AR-3588 | 1039 | m2442 | 28 ± 4.6 | 17.2 ± 8.7 |
| AR-3589 | 1040 | m2443 | 20.9 ± 5.4 | 15.9 ± 5.6 |
| AR-3590 | 1041 | m2444 | 22.5 ± 11.4 | 10.2 ± 5.8 |
| AR-3591 | 1042 | m2445 | 14.5 ± 12.3 | 7.8 ± 9.6 |
| AR-3592 | 1043 | m2446 | 26.8 ± 3.3 | 13.9 ± 8.7 |
| AR-3593 | 1044 | m2447 | 26.9 ± 4.4 | 9 ± 2.6 |
| AR-3594 | 1045 | m2448 | 30.1 ± 5.7 | 12.6 ± 12.5 |
| AR-3595 | 1046 | m2449 | 28.7 ± 18.7 | 9 ± 5.6 |
| AR-3596 | 1047 | m2450 | 30.5 ± 13.8 | 13.2 ± 9.7 |
| AR-3597 | 1048 | m2451 | 50.7 ± 34.2 | 17.9 ± 28.5 |
| AR-3598 | 1049 | m2452 | 20.8 ± 4.0 | 6.4 ± 8.5 |
| AR-3599 | 1050 | m2453 | 21.3 ± 7.9 | 10.7 ± 11.6 |
| AR-3599 | 1050 | m2453 | 17 ± 23.3 | 11 ± 4.6 |
| AR-3600 | 1051 | m2454 | 31.8 ± 5.7 | 18.5 ± 4.6 |
| AR-3601 | 1052 | m2455 | 20.6 | 8.8 |
| AR-3602 | 1053 | m2456 | 46.5 ± 18.0 | 37 ± 22 |
| AR-3603 | 1054 | m2457 | 34.7 ± 9.9 | 19.3 ± 8.8 |
| AR-3604 | 1055 | m2458 | 40.2 ± 4.2 | 39.5 ± 11.2 |
| AR-3604 | 1055 | m2458 | 59.3 ± 11.6 | 57.3 ± 7.0 |
| AR-3605 | 1056 | m2459 | 29 ± 9.1 | 15.1 ± 9.8 |
| AR-3606 | 1057 | m2460 | 65.8 ± 7.9 | 69.3 ± 8.3 |
| AR-3608 | 1059 | m2462 | 38.5 ± 7.2 | 28.4 ± 2.9 |
| AR-3608 | 1059 | m2462 | 66.8 ± 21.5 | 56.1 ± 8.5 |
| AR-3609 | 1060 | m2463 | 47.5 ± 2.5 | 43.2 ± 3.6 |
| AR-3610 | 1061 | m2464 | 92.1 ± 44.3 | 89 ± 55.9 |
| AR-3611 | 1062 | m2465 | 38.6 ± 7.7 | 30.3 ± 12.4 |
| AR-3612 | 1063 | m2466 | 16.2 ± 1.8 | 9.6 ± 11.4 |
| AR-3613 | 1064 | m2467 | 22.7 ± 8.8 | 11.8 ± 1.5 |
| AR-3614 | 1065 | m2468 | 25 ± 6.3 | 21 ± 5.9 |
| AR-3615 | 1066 | m2469 | 21.9 ± 9.8 | 15.2 ± 3.1 |
| AR-3616 | 1067 | m2470 | 20.5 ± 5.1 | 10 ± 5.4 |
| AR-3617 | 1068 | m2471 | 18.4 ± 6.2 | 8.8 ± 3.3 |
| AR-3618 | 1069 | m2472 | 47.1 ± 20.1 | 30.7 ± 20.4 |
| AR-3619 | 1070 | m2473 | 43.5 ± 3.6 | 26.3 ± 4.9 |
| AR-3620 | 1071 | m2474 | 33.7 ± 16.1 | 22 ± 12.4 |
| AR-3621 | 1072 | m2475 | 31.9 ± 6.6 | 19 ± 9.5 |
| AR-3622 | 1073 | m2476 | 70.3 ± 3.9 | 54.8 ± 3.4 |
| AR-3623 | 1074 | m2477 | 44.5 ± 3.3 | 28.7 ± 1.5 |
| AR-3624 | 1075 | m2478 | 37.8 ± 7.5 | 21.5 ± 10.8 |
| AR-3625 | 1076 | m2479 | 31.1 | 21.8 |
| AR-3626 | 1077 | m2480 | 41 ± 3.1 | 30.6 ± 2.6 |
| AR-3627 | 1078 | m2481 | 65.8 ± 8.5 | 53.2 ± 8.7 |
| AR-3628 | 1079 | m2482 | 58.1 ± 11.5 | 42 ± 13.5 |
| AR-3629 | 1080 | m2483 | 47.5 ± 11.0 | 38.7 ± 7.7 |
| AR-3630 | 1081 | m2484 | 60.2 ± 8.0 | 57.5 ± 8.1 |
| AR-3631 | 1082 | m2485 | 108.9 ± 25.3 | 86.8 ± 20.4 |
| AR-3632 | 1083 | m2486 | 63.6 ± 4.7 | 48.5 ± 3.2 |
| AR-3633 | 1084 | m2487 | 36.8 ± 5.1 | 27 ± 1.1 |
| AR-3634 | 1085 | m2488 | 29.8 ± 7.0 | 21 ± 5.8 |
| AR-3635 | 1086 | m2489 | 29.1 ± 12.1 | 11.4 ± 1.5 |
| AR-3636 | 1087 | m2490 | 41.8 ± 4.2 | 30.2 ± 12.4 |

TABLE 14-continued

AR Inhibitory Efficacy of DsiRNAs Assayed at 1 nM in Mouse LMTK-Cells

| Human AR Target Location (Long transcript) | Human AR Target (Short transcript) | Mouse AR Target Location | Mm AR 1554-1667 (FAM) | Mm AR 2413-2528 (Yakima Yellow) |
|---|---|---|---|---|
| AR-3637 | 1088 | m2491 | 35.3 ± 7.0 | 28.4 ± 4.3 |
| AR-3638 | 1089 | m2492 | 30.2 ± 6.2 | 19.2 ± 11.8 |
| AR-3639 | 1090 | m2493 | 26.9 ± 17.6 | 9.8 ± 5.8 |
| AR-3640 | 1091 | m2494 | 26.4 ± 8.8 | 12.9 ± 12.7 |
| AR-3641 | 1092 | m2495 | 35.8 ± 3.0 | 23 ± 4.5 |
| AR-3642 | 1093 | m2496 | 70.6 ± 11.4 | 57.3 ± 14.8 |
| AR-3643 | 1094 | m2497 | 62.4 ± 9.1 | 48.7 ± 5.6 |
| AR-3663 | 1114 | m2517 | 77.8 ± 12.3 | 27.6 ± 12.6 |
| AR-3664 | 1115 | m2518 | 50.9 ± 18.6 | 45.5 ± 13.3 |
| AR-3684 | 1135 | m2538 | 86.4 ± 16.7 | 73.1 ± 18.1 |
| AR-3685 | 1136 | m2539 | 62.6 ± 9.9 | 53.2 ± 10.2 |
| AR-3705 | 1156 | m2559 | 40.2 ± 5.0 | 32.5 ± 4.3 |
| AR-3706 | 1157 | m2560 | 84.4 | 73.8 |
| AR-3707 | 1158 | m2561 | 72.2 ± 10.0 | 75.8 ± 7.3 |
| AR-3708 | 1159 | m2562 | 101.4 ± 6.4 | 100.9 ± 6.3 |
| AR-3709 | 1160 | m2563 | 70.6 ± 9.8 | 66.1 ± 10.7 |
| AR-3710 | 1161 | m2564 | 73.1 ± 8.0 | 75.3 ± 13.1 |
| AR-3711 | 1162 | m2565 | 92.8 ± 6.7 | 84.3 ± 8.1 |
| AR-3712 | 1163 | m2566 | 53.2 ± 7.8 | 48.7 ± 3.4 |
| AR-3713 | 1164 | m2567 | 57.4 ± 15.2 | 55.1 ± 11.1 |
| AR-3714 | 1165 | m2568 | N/A | N/A |
| AR-3715 | 1166 | m2569 | 54.3 ± 7.3 | 54.5 ± 7.1 |
| | | AR-m2571 | 78.4 ± 5.0 | 59.5 ± 5.6 |
| | | AR-m2580 | 113 ± 7.5 | 109.5 ± 6.9 |
| | | AR-m2585 | 48.7 ± 4.0 | 43 ± 2.2 |
| | | AR-m2591 | 82.1 ± 5.4 | 69.6 ± 12.3 |
| | | AR-m2597 | 49.6 ± 7.8 | 49.1 ± 6.3 |
| AR-3753 | 1204 | m2607 | 33.6 ± 12.1 | 23.8 ± 8.4 |
| AR-3754 | 1205 | m2608 | 39.3 ± 3.2 | 23.1 ± 13.9 |
| AR-3755 | 1206 | m2609 | 41.4 ± 7.9 | 20.9 ± 8.3 |
| AR-3756 | 1207 | m2610 | 47.8 ± 8.5 | 32.8 ± 9.9 |
| AR-3757 | 1208 | m2611 | 39.6 ± 9.2 | 26.2 ± 13.1 |
| AR-3758 | 1209 | m2612 | 40.9 ± 8.4 | 27.2 ± 3.4 |
| AR-3759 | 1210 | m2613 | 40.8 ± 2.3 | 21.8 ± 13.6 |
| AR-3760 | 1211 | m2614 | 55 ± 30.3 | 58.1 ± 29.9 |
| AR-3761 | 1212 | m2615 | 38.6 ± 7.5 | 23.2 ± 8.7 |
| AR-3762 | 1213 | m2616 | 27.5 ± 6.8 | 15.3 ± 7.9 |
| AR-3763 | 1214 | m2617 | 23.5 ± 6.0 | 23.4 ± 2.8 |
| AR-3764 | 1215 | m2618 | 31.9 ± 1.9 | 22.8 ± 11.3 |
| AR-3765 | 1216 | m2619 | 24.2 ± 16 | 16.9 ± 14.5 |
| AR-3766 | 1217 | m2620 | 27.2 ± 12.0 | 13.8 ± 10.1 |
| AR-3767 | 1218 | m2621 | 27.6 | 15 |
| AR-3768 | 1219 | m2622 | 19.3 ± 2.2 | 13.1 ± 5.2 |
| AR-3769 | 1220 | m2623 | 24 ± 14.4 | 18.5 ± 12.2 |
| AR-3770 | 1221 | m2624 | 23 ± 3.2 | 8.9 ± 4.6 |
| AR-3771 | 1222 | m2625 | 13.8 ± 1.7 | 9.3 ± 16.9 |
| AR-3772 | 1223 | m2626 | 23.5 ± 9.4 | 15.3 ± 3.8 |
| AR-3773 | 1224 | m2627 | 46.3 ± 8.2 | 45.5 ± 8.9 |
| AR-3798 | 1249 | m2652 | 83.7 ± 1.3 | 81.4 ± 4.2 |
| AR-3799 | 1250 | m2653 | 93.2 ± 10.1 | 87 ± 12.6 |
| | | AR-m2661 | 65.3 ± 14.3 | 49.9 ± 14.7 |
| AR-3819 | 1270 | m2673 | 47 ± 7.9 | 49.1 ± 6.5 |
| AR-3820 | 1271 | m2674 | 54.8 ± 15.0 | 58.8 ± 12.7 |
| AR-3821 | 1272 | m2675 | 70.1 ± 2.5 | 56.1 ± 5.0 |
| AR-3822 | 1273 | m2676 | 49.9 ± 11.1 | 62.3 ± 6.8 |
| AR-3823 | 1274 | m2677 | 65 ± 4.5 | 57.7 ± 7.7 |
| AR-3824 | 1275 | m2678 | 23.5 ± 12.2 | 16.8 ± 8.2 |
| AR-3825 | 1276 | m2679 | 47 ± 7.7 | 43.1 ± 1.2 |
| AR-3826 | 1277 | m2680 | 46.1 ± 9.1 | 36.4 ± 6.4 |
| AR-3827 | 1278 | m2681 | 46.1 ± 14.9 | 37.7 ± 15.7 |
| AR-3828 | 1279 | m2682 | 63.7 ± 22.2 | 38.7 ± 9.0 |
| AR-3829 | 1280 | m2683 | 27.4 ± 7.2 | 21.3 ± 8.9 |
| AR-3830 | 1281 | m2684 | 51.3 ± 6.6 | 38.8 ± 1.3 |
| AR-3831 | 1282 | m2685 | 39.9 ± 4.2 | 18.6 ± 8.6 |
| AR-3832 | 1283 | m2686 | 38.6 ± 15.0 | 25.3 ± 5.7 |
| AR-3833 | 1284 | m2687 | 116.9 ± 23.4 | 85.8 ± 11.3 |
| AR-3834 | 1285 | m2688 | 64.4 ± 3.6 | 69 ± 2.3 |
| AR-3835 | 1286 | m2689 | 59.2 ± 8.0 | 51.9 ± 6.3 |
| AR-3836 | 1287 | m2690 | 23.9 ± 5.0 | 17.5 ± 10.3 |
| AR-3837 | 1288 | m2691 | 22.3 ± 1.5 | 15.8 ± 1.5 |
| AR-3838 | 1289 | m2692 | 40.5 ± 18.9 | 32.3 ± 17.9 |
| AR-3839 | 1290 | m2693 | 40.3 ± 8.5 | 28.2 ± 8.1 |
| AR-3840 | 1291 | m2694 | 24.9 ± 9.8 | 17.4 ± 9.7 |
| AR-3841 | 1292 | m2695 | 36.2 ± 3.2 | 22.1 ± 3.8 |
| AR-3842 | 1293 | m2696 | 39.1 | 32.2 |
| AR-3843 | 1294 | m2697 | 32.2 ± 12.2 | 25.7 ± 5.4 |
| AR-3844 | 1295 | m2698 | 26 ± 8.4 | 19.1 ± 2.8 |
| AR-3845 | 1296 | m2699 | 45.4 ± 5.7 | 41.9 ± 9.5 |
| AR-3846 | 1297 | m2700 | 49 ± 18.4 | 39.7 ± 11.4 |
| AR-3847 | 1298 | m2701 | 52.7 ± 13.9 | 36.7 ± 18.6 |
| AR-3848 | 1299 | m2702 | 46.7 ± 17.9 | 35.5 ± 14.8 |
| AR-3849 | 1300 | m2703 | 106.6 ± 17.2 | 86 ± 15.4 |
| AR-3850 | 1301 | m2704 | 63.1 ± 9.9 | 52 ± 4.9 |
| AR-3851 | 1302 | m2705 | 46.4 ± 10.7 | 46.3 ± 13.2 |
| AR-3852 | 1303 | m2706 | 28.2 ± 25.9 | 23.2 ± 5.8 |
| AR-3853 | 1304 | m2707 | 27.4 ± 10.0 | 26.6 ± 7.0 |
| AR-3854 | 1305 | m2708 | 48.9 ± 13.1 | 42.2 ± 6.6 |
| AR-3855 | 1306 | m2709 | 45.1 ± 10.5 | 26.4 ± 21.0 |
| AR-3856 | 1307 | m2710 | 47.3 ± 15.4 | 35.3 ± 7.2 |
| AR-3857 | 1308 | m2711 | 53.2 ± 7.4 | 48 ± 4.0 |
| AR-3858 | 1309 | m2712 | 21.6 ± 3.0 | 12.8 ± 11.3 |
| AR-3859 | 1310 | m2713 | 96.9 ± 10.8 | 92.7 ± 9.1 |
| AR-3860 | 1311 | m2714 | 111.2 ± 11.1 | 98.7 ± 8.5 |
| AR-3861 | 1312 | m2715 | 97.7 ± 10.2 | 103.8 ± 10.9 |
| AR-3862 | 1313 | m2716 | 62.7 ± 24.9 | 53.2 ± 15.4 |
| AR-3863 | 1314 | m2717 | 65.2 ± 11.0 | 46.9 ± 11.4 |
| AR-3864 | 1315 | m2718 | 44.5 ± 14.5 | 35.1 ± 13.6 |
| AR-3865 | 1316 | m2719 | 33 ± 2.6 | 25.4 ± 2.7 |
| AR-3866 | 1317 | m2720 | 34.1 ± 13.9 | 24.9 ± 5.9 |
| AR-3867 | 1318 | m2721 | 38.2 ± 10.7 | 34.6 ± 11.4 |
| AR-3868 | 1319 | m2722 | 25.8 ± 13.7 | 15.9 ± 9.8 |
| AR-3869 | 1320 | m2723 | 32.2 ± 15.5 | 40.3 ± 10.7 |
| AR-3870 | 1321 | m2724 | 28.6 ± 9.9 | 19.1 ± 15.2 |
| AR-3871 | 1322 | m2725 | 41.8 ± 19.7 | 30.3 ± 14.2 |
| AR-3947 | 1398 | m2801 | 15.6 ± 7.2 | 13.1 ± 4.9 |
| AR-3948 | 1399 | m2802 | 18.1 ± 13.0 | 10.9 ± 14.5 |
| AR-3949 | 1400 | m2803 | 22.7 ± 7.7 | 16.5 ± 7.7 |
| AR-3950 | 1401 | m2804 | 28.9 ± 8.9 | 20.3 ± 3.8 |
| | | AR-m2809 | 30.1 ± 11.1 | 29.8 ± 3.3 |
| | | AR-m2831 | 63.6 ± 15.8 | 66.4 ± 21.0 |
| | | AR-m2912 | 66.7 ± 3.0 | 44.9 ± 4.4 |
| | | AR-m2918 | 102.9 ± 13.6 | 92.7 ± 4.4 |
| | | AR-m2926 | 105.3 ± 9.5 | 117.6 ± 7.3 |
| AR-4086 | 1537 | m2931 | 71.6 ± 13.6 | 68.9 ± 12.2 |
| | | AR-m2981 | 37 ± 6.1 | 38.3 ± 8.5 |
| | | AR-m2992 | 36.8 ± 8.4 | 34.7 ± 9.9 |
| | | AR-m2997 | 49.3 ± 16.7 | 41.7 ± 20.5 |

As shown in above Table 13, 155 of 408 asymmetric DsiRNAs examined in human 22Rv1 cells showed greater than 70% reduction of human AR levels in 22Rv1 cells at 1 nM. Of these 155 DsiRNAs, 60 exhibited 80% or greater reduction of human AR levels in 22Rv1 cells at 1 nM. As shown in above Table 14, a number of asymmetric DsiRNAs capable of inhibiting mouse AR levels in mouse LMTK-cells at 1 nM in the environment of a cell were also identified in such assays.

Example 4

DsiRNA Inhibition of AR—Secondary Screen 72 asymmetric DsiRNAs of the above experiment were then examined in a secondary assay ("Phase 2"), with results of such assays presented in histogram form in FIGS. 2-5.

Figure 3:
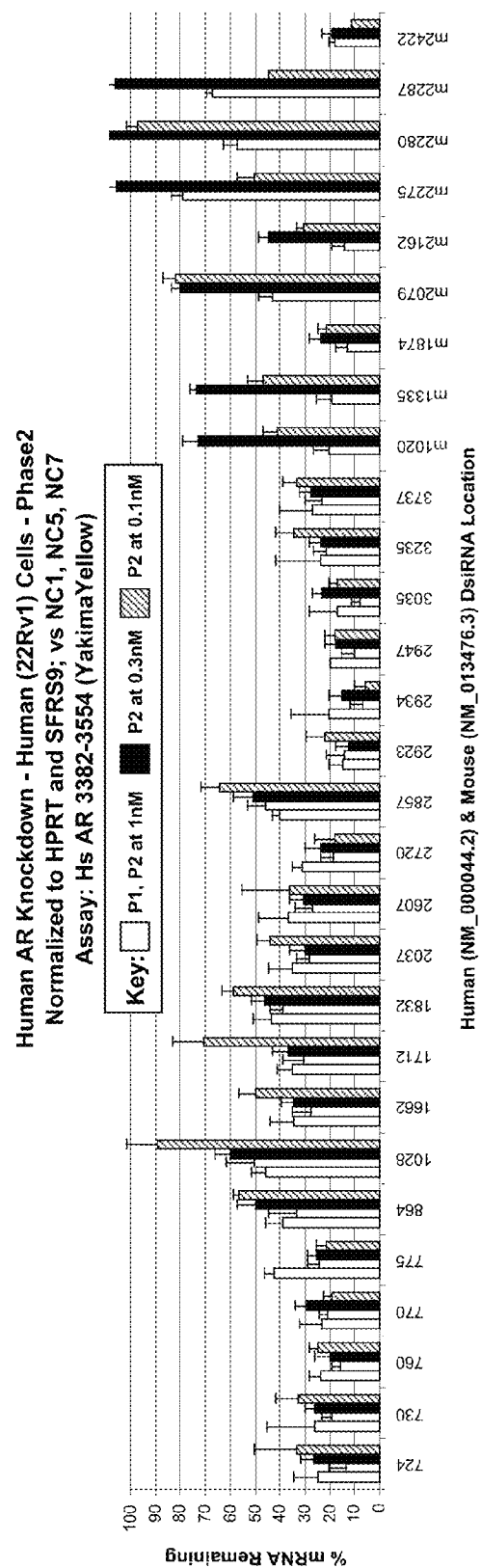
Figure 4:
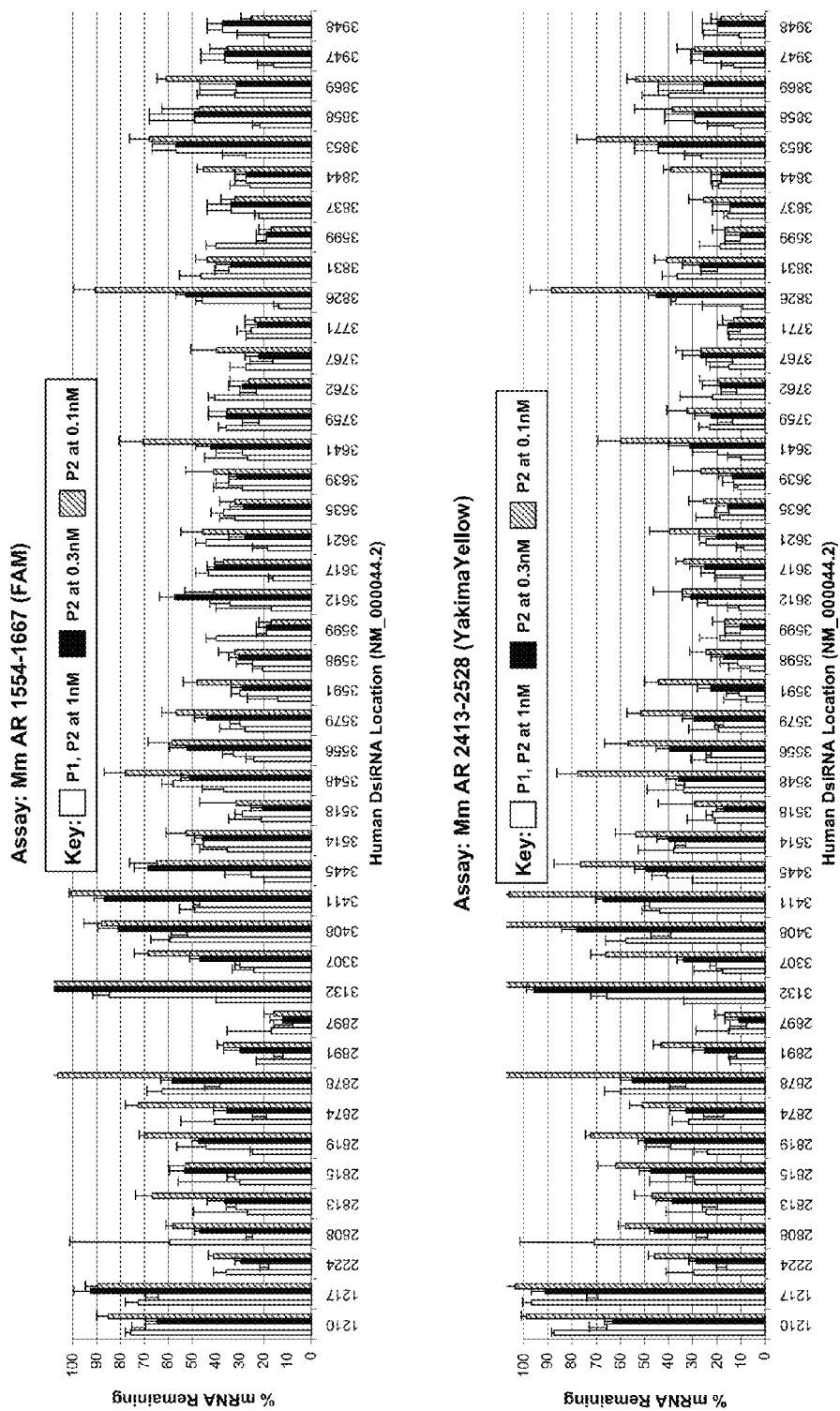
Figures 5, 7:
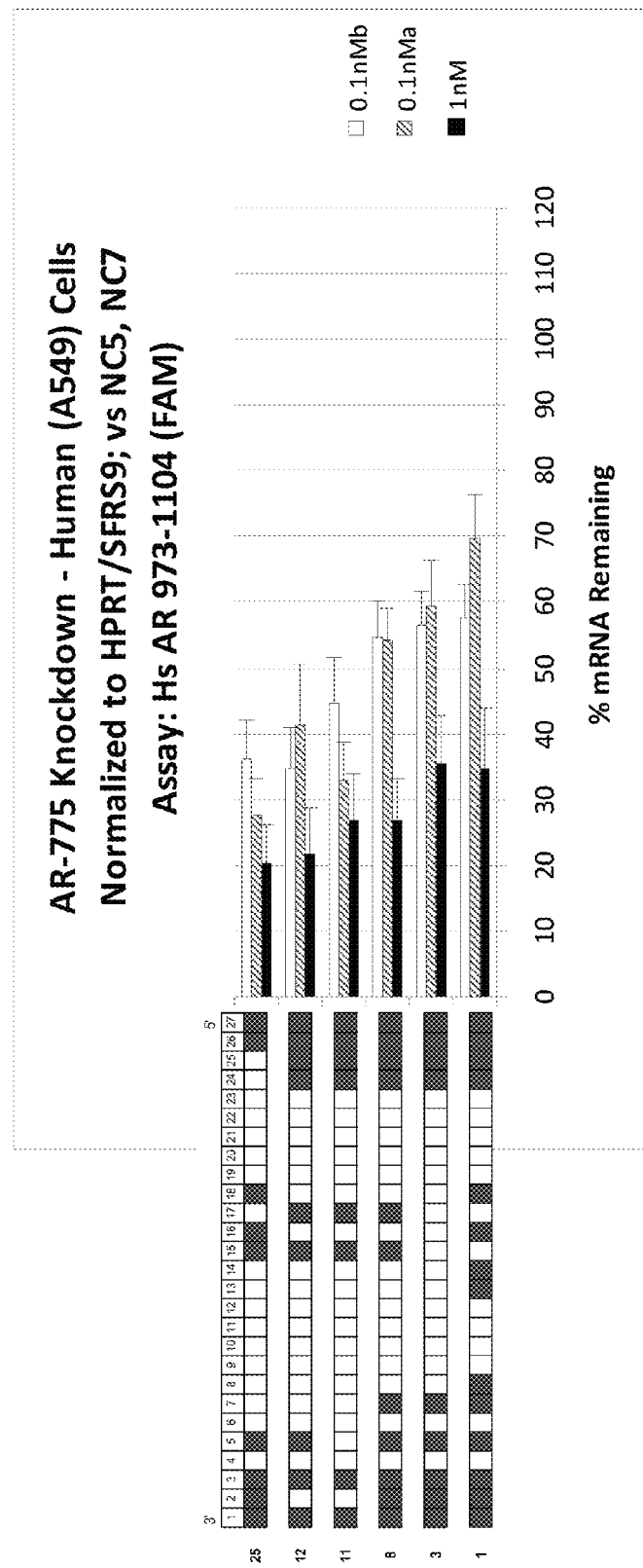
Figures 6, 7:
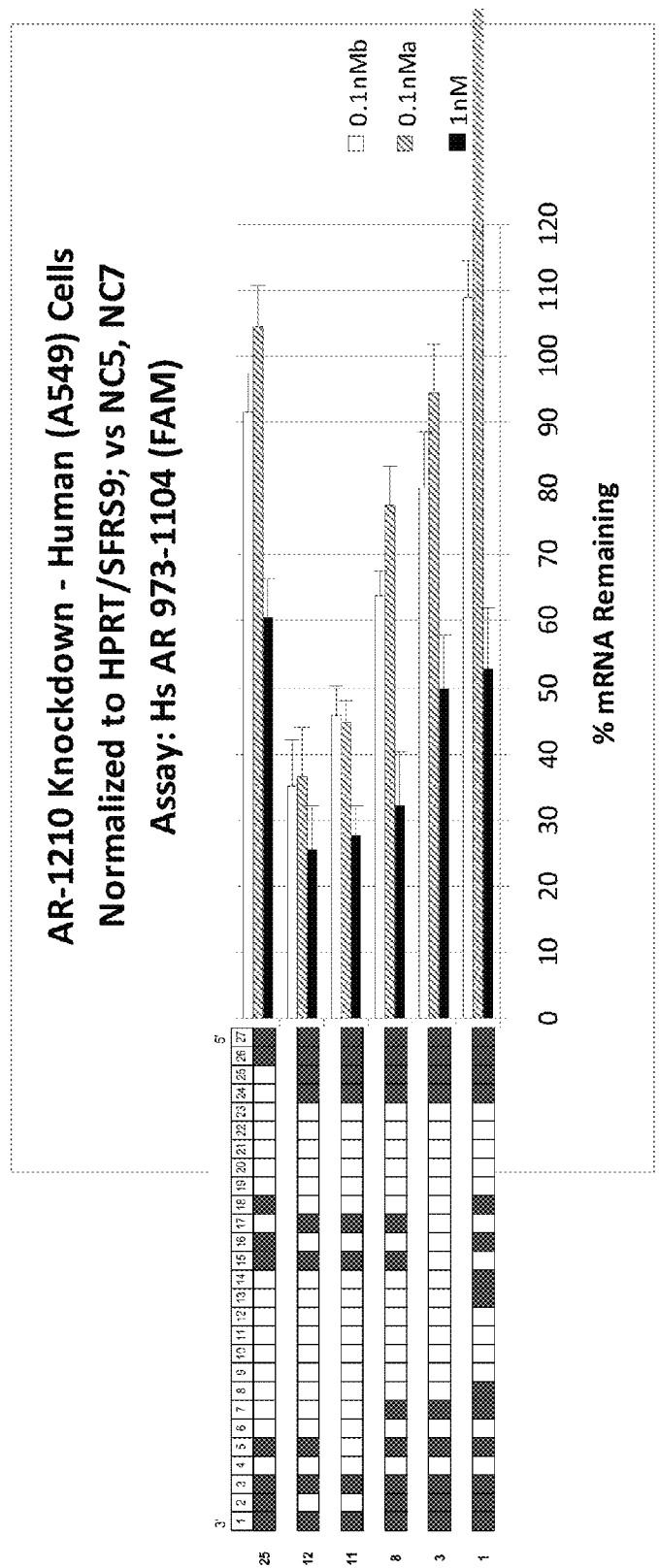
Figure 7:
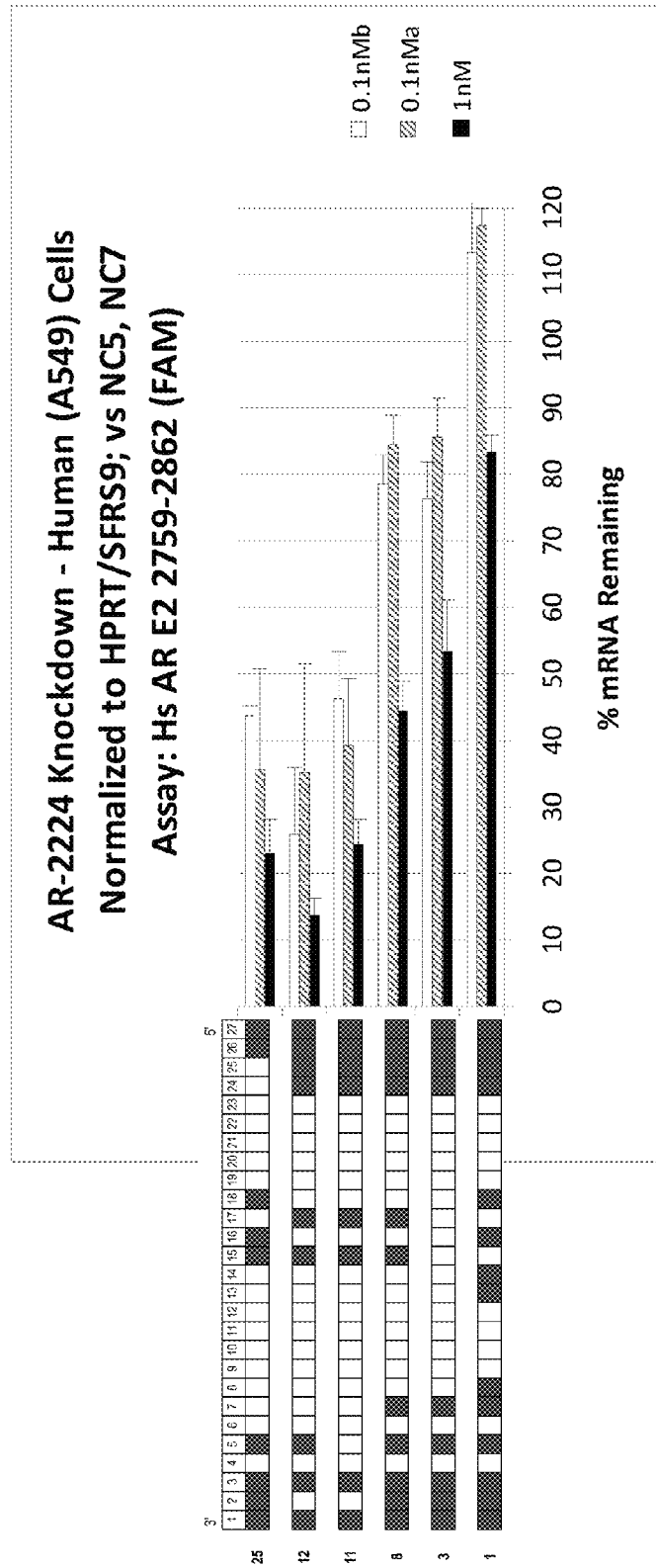

Specifically, the 72 asymmetric DsiRNAs selected from the 456 tested above were assessed for inhibition of human AR at 1 nM, 0.3 nM and 0.1 nM in the environment of human 22Rv1 cells (FIGS. 2 and 3). These 72 asymmetric DsiRNAs were also assessed for inhibition of mouse AR at 1 nM, 0.3 nM and 0.1 nM in the environment of mouse LMTK-cells (FIGS. 4 and 5). As shown in FIGS. 2 and 3, a remarkable number of asymmetric DsiRNAs reproducibly exhibited robust human AR inhibitory efficacies at sub-nanomolar concentrations when assayed in the environment of 22Rv1 cells. In addition, as shown in FIGS. 4 and 5, a number of these asymmetric DsiRNAs also showed robust mouse AR inhibitory efficacies at 1 nM, 300 pM and 100 pM when assayed in the environment of mouse LMTK-cells. (Meanwhile, both human AR-specific and mouse AR-specific inhibitory asymmetric DsiRNAs were also identified.)

Example 5

Inhibition of AR by Additional Preferred DsiRNAs

The remaining DsiRNA molecules shown in Tables 2 and 3 possessing sense and antisense strand sequences as shown and targeting AR wild-type sequences (and variant sequences where applicable) are designed and synthesized as described above and tested in 22Rv1 cells (and, optionally, in mouse LMTK-cells) for inhibitory efficacy as described in Examples 3 and 4 above. The ability of these DsiRNA agents to inhibit AR expression is optionally assessed in comparison to corresponding AR target sequence-directed 21mer siRNAs (21 nucleotide target sequences of AR dsRNA agents described herein are presented in Table 4 above). A significant number of the remaining selected DsiRNA agents of Tables 2 and 3 above are expected to show efficacy as AR inhibitors, and are tested at 1 nM, 300 pM and at 100 pM concentrations in the environment of a cell. These additional DsiRNAs and the DsiRNAs tested herein are also examined for the ability to outperform cognate siRNAs, as determined via measurement of efficacy in decreasing levels of AR target relative to a cognate 21mer siRNA agent. The duration of such inhibitory effects is also examined at both 24 hours and 48 hours post-administration, with concentrations of 0.1 nM, 0.3 nM, 1 nM and 5 nM tested. DsiRNAs of the instant invention are thereby examined for the ability to outperform their cognate 21mer siRNA, as determined via measurement of potency and/or duration of effect.

The DsiRNA molecules shown in Tables 5-8 above are also similarly synthesized and tested.

Example 6

Figure 6:
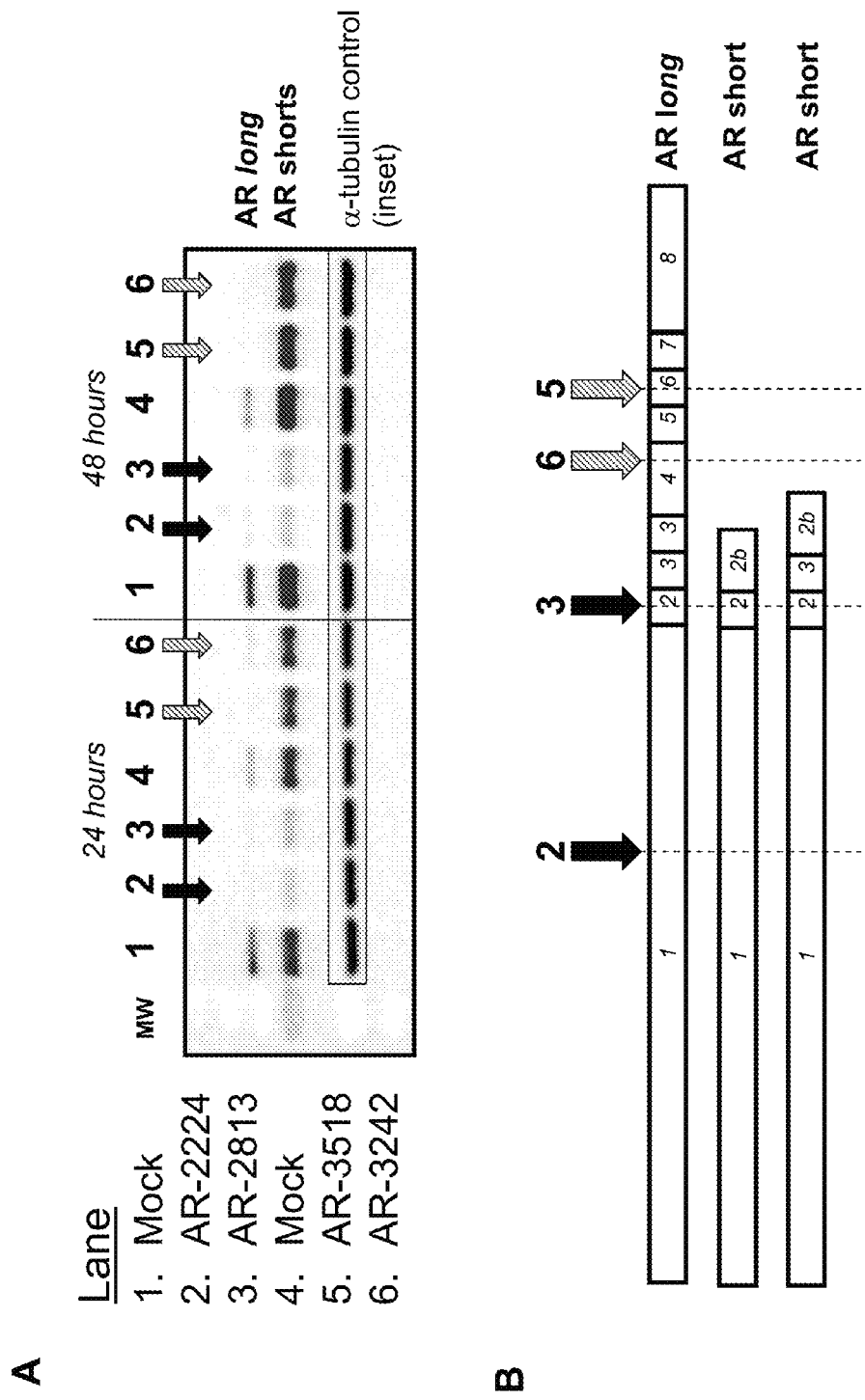
FIGS. 6A and 6B show that DsiRNA-mediated AR protein knockdown correlated with location of targeted AR sites within the AR transcript.

AR Targeting DsiRNA-Mediated Knockdown of AR Protein in 22Rv1 Human Prostate Cancer Cells To confirm that DsiRNA-mediated knockdown of AR transcript also produced significant AR polypeptide knockdown, AR protein levels were examined in DsiRNA-treated 22Rv1 cells expressing AR. As shown in FIG. 6A, DsiRNA-mediated AR protein knockdown was shown to be effective and was demonstrated to correlate with location of targeted AR sites within the AR transcript. AR polypeptides corresponding to both long and short forms of the AR transcript (as schematically depicted in FIG. 6B) were effectively knocked down at both 24 and 48 hours post-administration of AR-targeting DsiRNAs AR-2224 and AR-2213. In contrast, only AR polypeptide corresponding to the long form of the AR transcript was effectively knocked down by AR-targeting DsiRNAs AR-3518 and AR-3242. (AR-2224 and AR-2813 DsiRNAs were directed against both long and short forms of the AR transcript, whereas AR-3518 and AR-3242 DsiRNAs were specific for sequences contained only within the long form of the AR transcript.) These data demonstrated that DsiRNAs shown to be effective at inhibiting the AR transcript were also effective inhibitors of AR polypeptide levels, and that DsiRNAs targeting both long and short forms of the AR transcript or specific for only the long form of the AR transcript showed corresponding selectivity of AR polypeptide knockdown.

Example 7

Modified Forms of AR-Targeting DsiRNAs Reduce AR Levels In Vitro

32 AR-targeting DsiRNAs (AR-724, AR-730, AR-760, AR770, AR-775, AR-1210, AR-2224, AR-2720, AR-2808, AR-2813, AR-2815, AR-2819, AR-2874, AR-2897, AR-2934, AR-3518, AR-3548, AR-3576, AR-3599, AR-3617, AR-3635, AR-3641, AR-3759, AR-3762, AR-3767, AR-3771, AR-3837, AR-3844, AR-3853, AR-3869, AR-3948 and AR-m2422) were prepared with 2'-O-methyl modification patterns as shown in schematics of FIGS. 7-1 to 7-32. For each of the 32 DsiRNA sequences, DsiRNAs possessing each of the six modification patterns were assayed for AR inhibition in human A549 cells at 0.1 nM (in parallel assays) and 1.0 nM concentrations in the environment of the A549 cells. Results of these experiments are presented as histograms in FIGS. 7-1 to 7-32. In general, the 32 DsiRNA sequences exhibited a trend towards reduced efficacy of AR inhibition as the extent of 2'-O-methyl modification of the guide strand increased. However, for almost all DsiRNA sequences examined a modification pattern could be identified that allowed the DsiRNA to retain significant AR inhibitory efficacy in vitro. It was also notable that many DsiRNAs (e.g., AR-2934, AR-3518, AR-3759, AR-3771, AR-3948) exhibited robust AR inhibitory efficacy in even the most highly modified states examined. These data confirm that it will likely be possible to identify effective DsiRNA sequences possessing sufficient levels of modification to stabilize such DsiRNAs and/or reduce immunogenicity of such DsiRNAs when therapeutically administered to a subject in vivo.

In certain embodiments, the invention provides a DsiRNA selected from among one or more of the following:

TABLE 13

Select AR-Targeting DsiRNAs

| DsiRNA Name | 27 nt Target Sequence | 21 nt Target Sequence |
| --- | --- | --- |
| AR-724 | SEQ ID NO: 317 | SEQ ID NO: 623 |
| AR-730 | SEQ ID NO: 319 | SEQ ID NO: 625 |
| AR-760 | SEQ ID NO: 327 | SEQ ID NO: 633 |
| AR-770 | SEQ ID NO: 330 | SEQ ID NO: 636 |
| AR-775 | SEQ ID NO: 332 | SEQ ID NO: 638 |
| AR-2222 | SEQ ID NO: 2380 | SEQ ID NO: 3190 |
| AR-2607 | SEQ ID NO: 2389 | SEQ ID NO: 3199 |
| AR-2720 | SEQ ID NO: 2391 | SEQ ID NO: 3201 |
| AR-2808 | SEQ ID NO: 2392 | SEQ ID NO: 3202 |
| AR-2813 | SEQ ID NO: 2397 | SEQ ID NO: 3207 |
| AR-2815 | SEQ ID NO: 2399 | SEQ ID NO: 3209 |
| AR-2819 | SEQ ID NO: 2403 | SEQ ID NO: 3213 |
| AR-2947 | SEQ ID NO: 377 | SEQ ID NO: 683 |
| AR-3235 | SEQ ID NO: 2479 | SEQ ID NO: 3289 |
| AR-3445 | SEQ ID NO: 1346 | SEQ ID NO: 1472 |
| AR-3576 | SEQ ID NO: 2541 | SEQ ID NO: 3351 |

TABLE 13-continued

Select AR-Targeting DsiRNAs

| DsiRNA Name | 27 nt Target Sequence | 21 nt Target Sequence |
|---|---|---|
| AR-3599 | SEQ ID NO: 399 | SEQ ID NO: 705 |
| AR-3664 | SEQ ID NO: 2609 | SEQ ID NO: 3419 |
| AR-3737 | SEQ ID NO: 2625 | SEQ ID NO: 3435 |
| AR-3759 | SEQ ID NO: 2632 | SEQ ID NO: 3442 |
| AR-3762 | SEQ ID NO: 2635 | SEQ ID NO: 3445 |
| AR-3767 | SEQ ID NO: 2640 | SEQ ID NO: 3450 |
| AR-3771 | SEQ ID NO: 2644 | SEQ ID NO: 3454 |

Among the DsiRNAs of Table 13 that were tested in the above-described modified DsiRNA assays, AR-724, AR-730, AR-760, AR-770, AR-775, AR-2720, AR-2808, AR-2815, AR-2819, AR-3576, AR-3599, AR-3759, AR-3762, AR-3767 and AR-3771 were shown to be robustly effective DsiRNA sequences even when modified (and AR-760, AR-775, AR-2815, AR-3576, AR-3599, AR-3759, AR-3762, AR-3767 and AR-3771 were observed to be highly effective inhibitors of AR under all modification conditions examined). In certain related embodiments, selected AR-targeting DsiRNAs are AR-2813, AR-2815 and AR-3599 (and optionally, AR-2815 and AR-3599).

Example 8

In Vivo Efficacy of AR-Targeting DsiRNAs in Lung Tissue

To test the activity of a DsiRNA directed against AR in vivo, CD1 male mice were administered AR-2813. Mice were treated by iv tail vein injection with either 5% glucose (control vehicle), a control DsiRNA SCR2, or AR-2813. DsiRNAs were formulated in InVivoFectamine™ (InVitrogen)™ (InVitrogen), and were administered at a dose of 10 mg/kg body weight per administration (administered on two days separated by one non-dosing day). Three days after the last administration, animals were sacrificed and lungs were harvested. For RNA expression analysis, RNA was isolated from lung tissue lysates using a Promega™ SV96 RNA isolation kit. RNA was reverse-transcribed, and then Taqman quantitative PCR was performed on a BioRad CFX96, in multiplex using primer and probe sets specific for AR and the housekeeping gene GAPDH for normalization. For confirmation of results, three different qPCR assays for AR were used (named AR961, AR1554, and AR2).

Figures 7, 8:
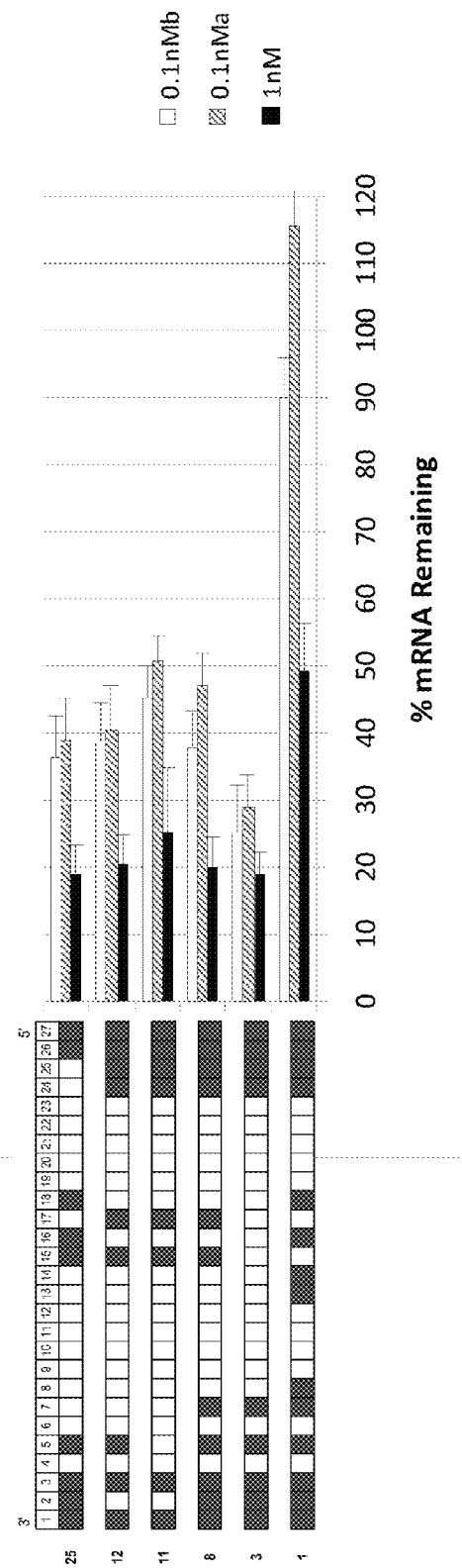

As shown in FIG. 8, the AR-2813 DsiRNA exhibited remarkable efficacy of in vivo knockdown of AR in harvested lung tissues. Specifically, AR RNA levels were reduced in assayed lung tissues of AR-2813 administered animals by approximately 50-80% as compared to control lung samples. Accordingly, AR-targeting DsiRNAs were shown to be potent and effective inhibitors of AR in vivo, in lung tissues.

Example 9

Figures 7, 8, 9:
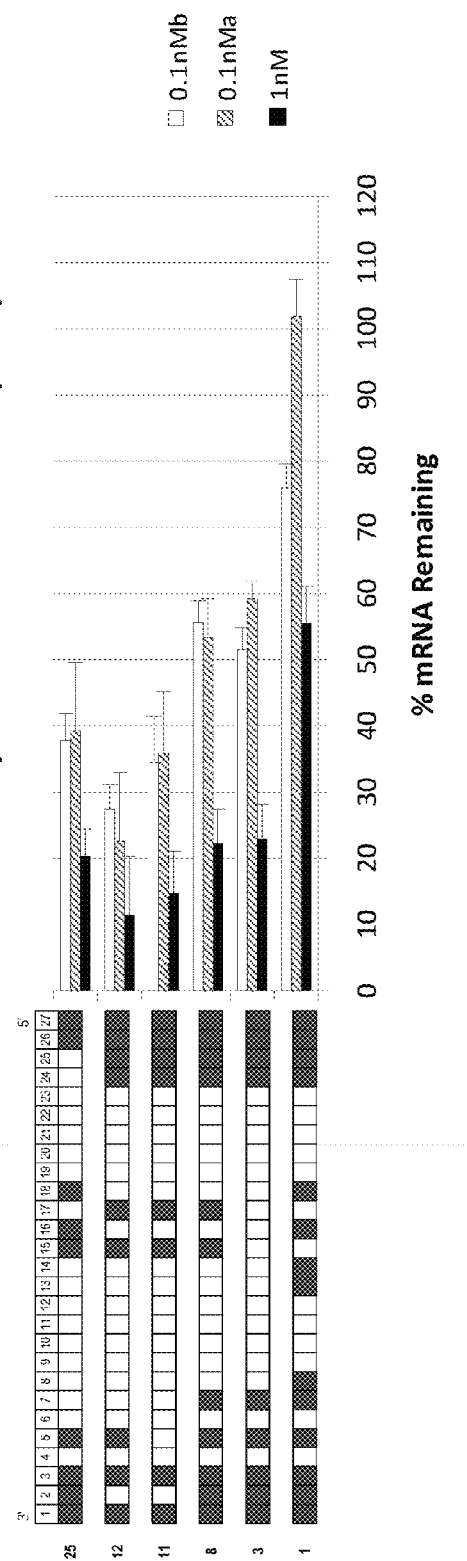
Figures 7, 8, 9, 10:
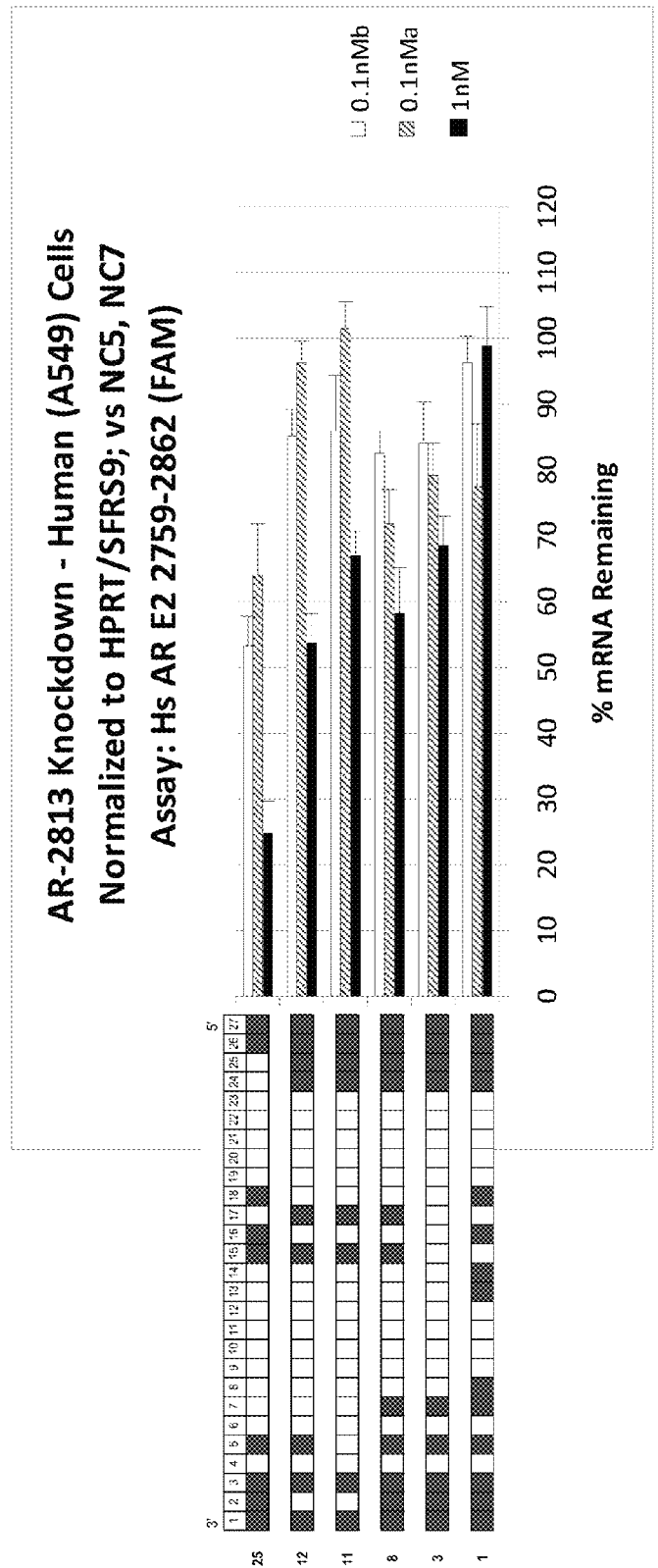

$IC_{50}$ Values Calculated for AR-Targeting DsiRNA that Knocked Down AR Expression in Human 22Rv1 Prostate Cancer Cells and A549 Adenocarcinoma Cells Example 6 above confirmed that AR-targeting DsiRNAs produced knockdown of both AR transcript and polypeptide in DsiRNA-treated 22Rv1 cells expressing AR. Using the active AR-2813 DsiRNA, the above results were confirmed and expanded upon to identify $IC_{50}$ values associated with such knockdown. To perform such experiments, 22Rv1 cells were transfected in vitro, using the lipid transfection reagent RNAiMAX, and dose curve concentrations of the AR-2813 DsiRNA or mock treatment. Two days post-transfection, cells were lysed and protein expression was determined by Western analysis using an anti-AR antibody or to an anti-α-tubulin antibody as a control. As shown in FIG. 9, multiple AR proteins were detected in 22Rv1 cells, representing full-length AR (upper bands) and truncated AR proteins resulting from mutations in this cell line (lower bands). DsiRNA-mediated AR protein knockdown was shown to be effective against both long and short forms of AR polypeptide (top panels), at both one and two days post-DsiRNA administration to 22Rv1 cells. $IC_{50}$ values associated with both AR long form polypeptide inhibition (54.6 pM at day 1 and 5 pM at day 2) and AR short form polypeptide inhibition (86.8 pM at day 1 and 13.6 pM at day 2) were calculated, demonstrating the remarkable potency of the AR-2813 DsiRNA as an inhibitory agent. The AR-2813 DsiRNA also was confirmed to inhibit AR mRNA levels dramatically (e.g., by at least 50% to greater than 80% reduction, depending upon assayed concentration of DsiRNA).

AR-targeting DsiRNAs were also found to inhibit AR mRNA expression in A549 (adenocarcinomic human alveolar basal epithelial) cells. As demonstrated in the dose-response curves of FIG. 10, multiple AR-targeting DsiRNAs were observed to be potent inhibitors of AR expression in A549 cells. Specifically, A549 cells were transfected in vitro, using the lipid transfection reagent RNAiMAX formulated with dose curve concentrations of AR-targeting DsiRNAs as indicated. Two days post-transfection, lysates cells were lysed and total RNA was extracted using an SV 96 Total RNA Isolation System (Promega). cDNA was made using a Transcriptor First Strand cDNA Synthesis Kit (Roche, using random primer and a heating step of 5' @70° C. qPCR was performed using iQ Multiplex Powermix and corresponding primer probe sets (BIO-RAD). $IC_{50}$ values were calculated for each of the following assayed AR-targeting DsiRNAs: AR-2813-M25 ($IC_{50}$=21 pM), AR-2815-M12 ($IC_{50}$=0.7 pM), AR-2874-M12 ($IC_{50}$=0.4 pM), AR-3518-M12 ($IC_{50}$=0.086 pM) and AR-3599-M25 ($IC_{50}$=1.57 pM).

Example 10

Figures 7, 8, 9, 10, 11:
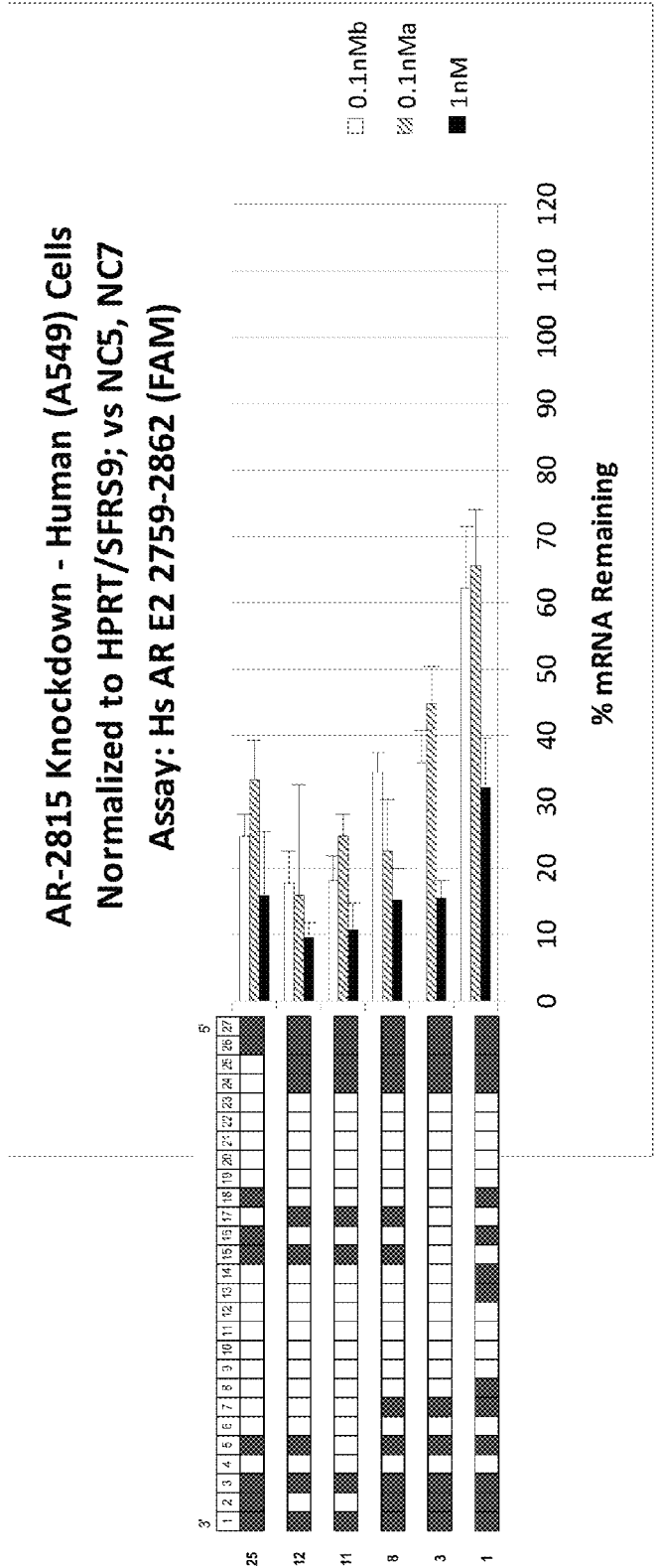
Figures 7, 8, 9, 10, 11, 12:
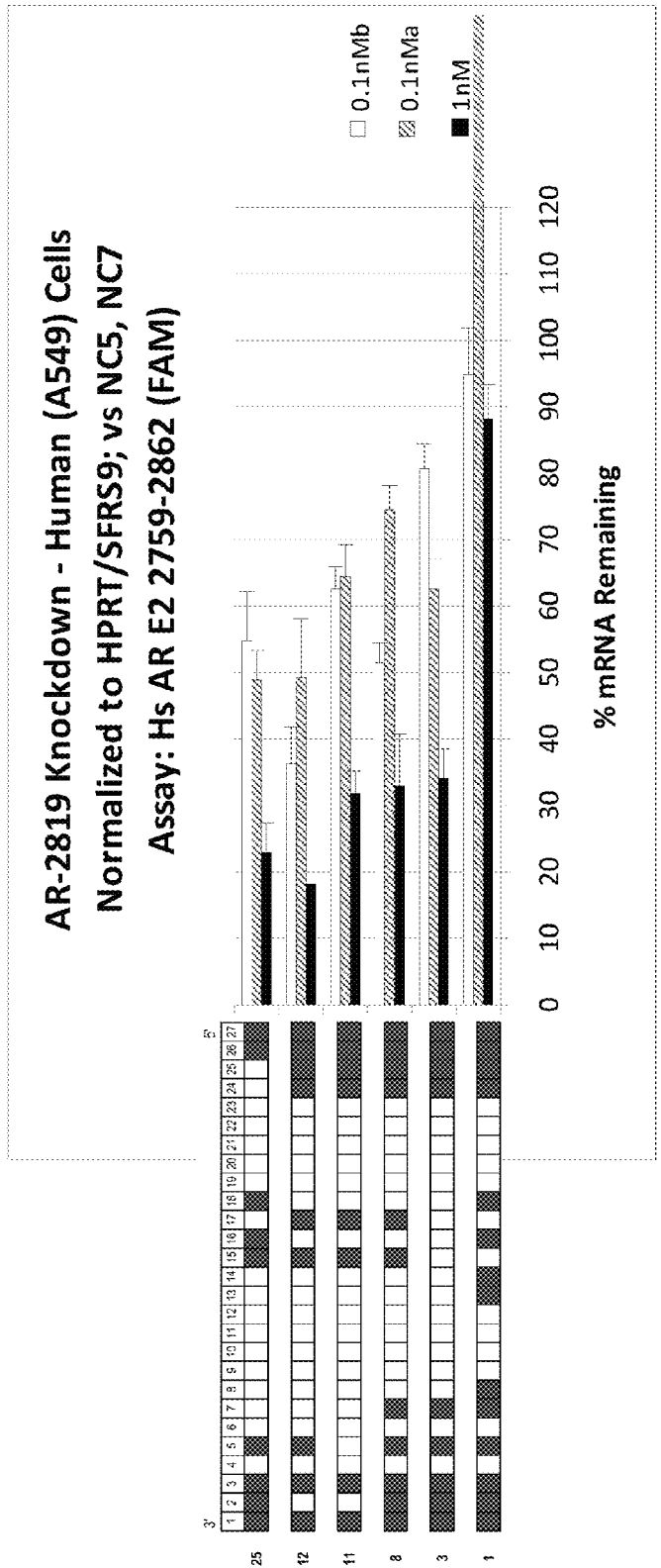

AR-Targeting DsiRNAs Inhibited Tumor Cell Growth in Prostate Cancer Cell Lines To identify whether AR-targeting DsiRNAs could impact cell growth in cancer cells known to express AR, AR-targeting DsiRNAs were administered to prostate cancer cell lines 22Rv1 (FIG. 11) and VCaP (FIG. 12). As shown in FIG. 11, transfection of human prostate cancer cell line 22Rv1 cells with the AR-targeting DsiRNA AR-2813 produced a dramatic (at least 50%) inhibition of cell growth in 22Rv1 cells, as compared to such cells transfected with a control DsiRNA (in such experiments, 22Rv1 cells were transfected for five hours in vitro with DsiRNA using RNAiMAX, and at six days post-transfection, growth of the cells was measured via a cell growth assay (Promega)). Expanding upon such results, FIG. 12 demonstrates that modified AR-targeting DsiRNAs (specifically, the AR-3599 and AR-2813 DsiRNAs having antisense (guide) strand modification pattern "M25" as presented in FIG. 7) potently inhibited VCaP (human prostate cancer) cell growth following administration to such cells (in these experiments, cell growth values were assessed at five days post-transfection-mediated administration of DsiRNAs).

Remarkably, treatment of VCaP cells with AR DsiRNAs inhibited growth of the VCaP prostate cancer cell line at transfection concentrations as low as 30 pM (for AR-3599-M25, cell growth was inhibited by at least 50% at 30 pM concentration). Thus, DsiRNAs were observed to be surprisingly potent inhibitors of prostate cancer cell growth.

Example 11

In Vivo Efficacy of AR-Targeting DsiRNAs in Liver Tissue

To further examine the activities of DsiRNAs directed against AR in vivo, two month old nu/nu male mice (n=7) were injected with AR DsiRNAs formulated in InVivo-Fectamine™ (InVitrogen) 2.0 (Invitrogen) and administered at a dose of 10 mg/kg (iv) on days one and four. Three additional groups of seven mice each (PBS, no treatment or administered an HPRT1 control DsiRNA) were included in this study as control groups. Liver tissues were harvested at 48 hrs after administration of the second dose and were stored in solution (RNAse Easy) for later use. A small portion of liver tissues were homogenized in 500 µl of QIAzol lysis buffer, mixed with 500 µl of chloroform and were centrifuged. 100 µl of upper aqueous layer was transferred to SV 96 binding plate and RNA was extracted using an SV 96 Total RNA Isolation System (Promega). cDNA was made using a Transcriptor First Strand cDNA Synthesis Kit (Roche, using random primer and a heating step of 5' @70° C. qPCR was performed using iQ Multiplex Powermix (BIO-RAD) and corresponding primer probe sets from Applied Biosystems (TaqMan® Gene Expression Assays). GAPDH, a housekeeping gene was used as internal control for quantitation.

Figures 7, 8, 9, 10, 11, 12, 13:
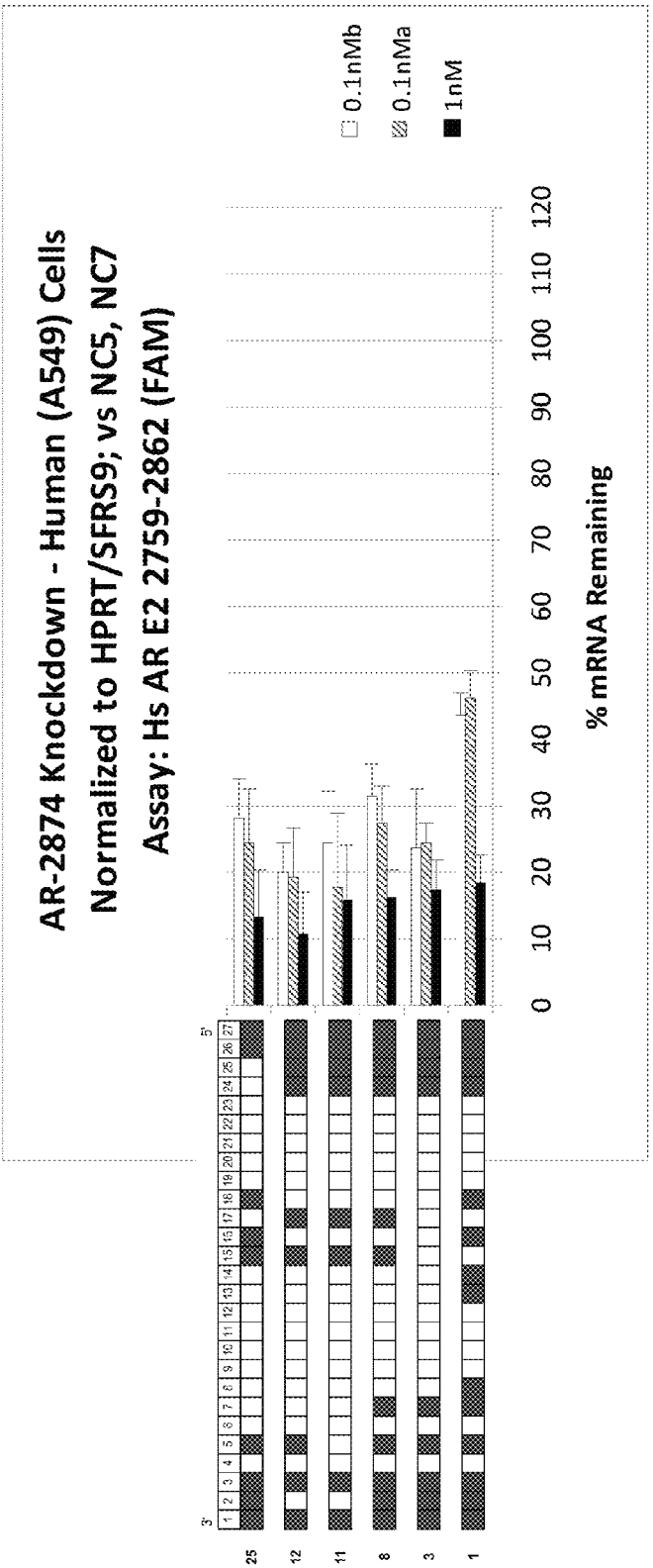

As shown in FIG. 13, four distinct AR-targeting DsiRNAs (AR-2815-M12, AR-2874-M12, AR-3518-M12 and AR3599-M25) each reduced AR mRNA expression in normal liver tissue by at least 80% (in certain cases, at least 90% or even 95%) as compared to untreated, PBS- or control oligonucleotide-treated controls.

Figures 7, 8, 9, 10, 11, 12, 13, 14:
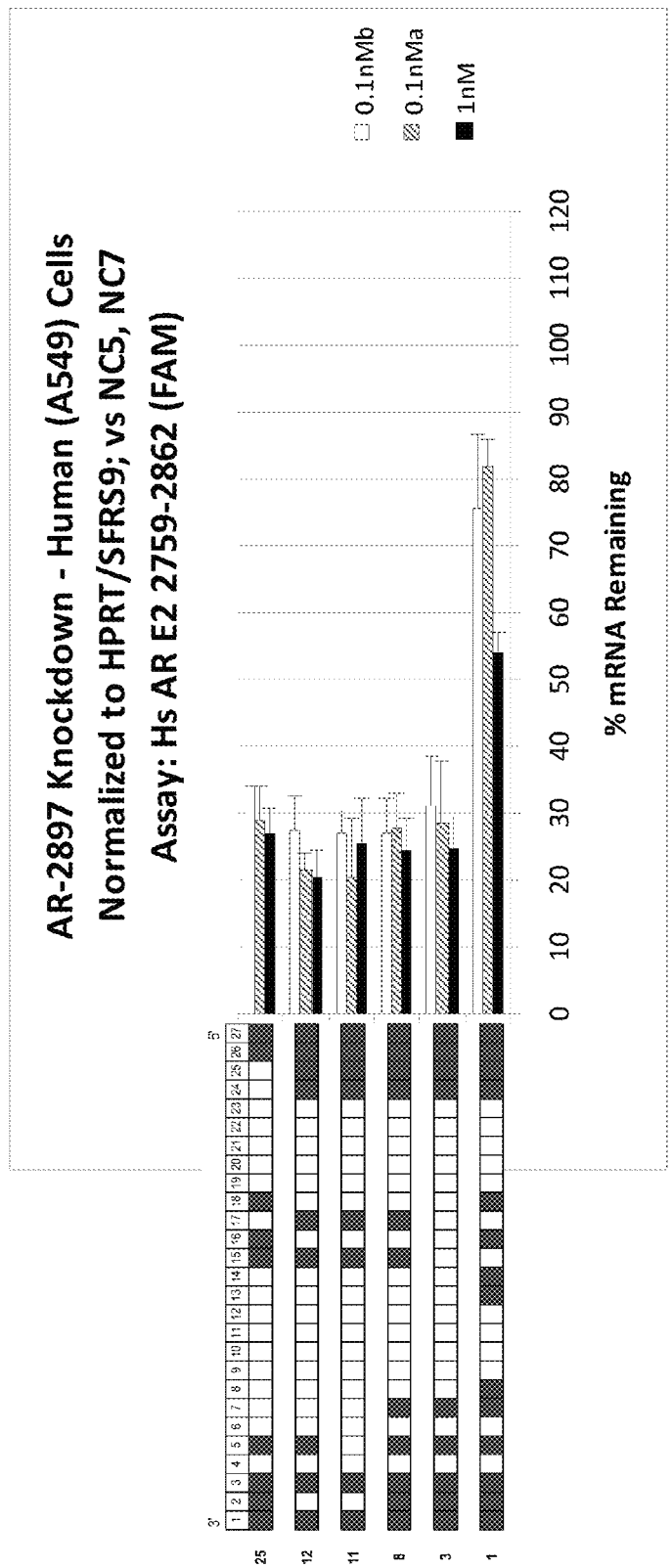
Figures 7, 8, 9, 10, 11, 12, 13, 14, 15:
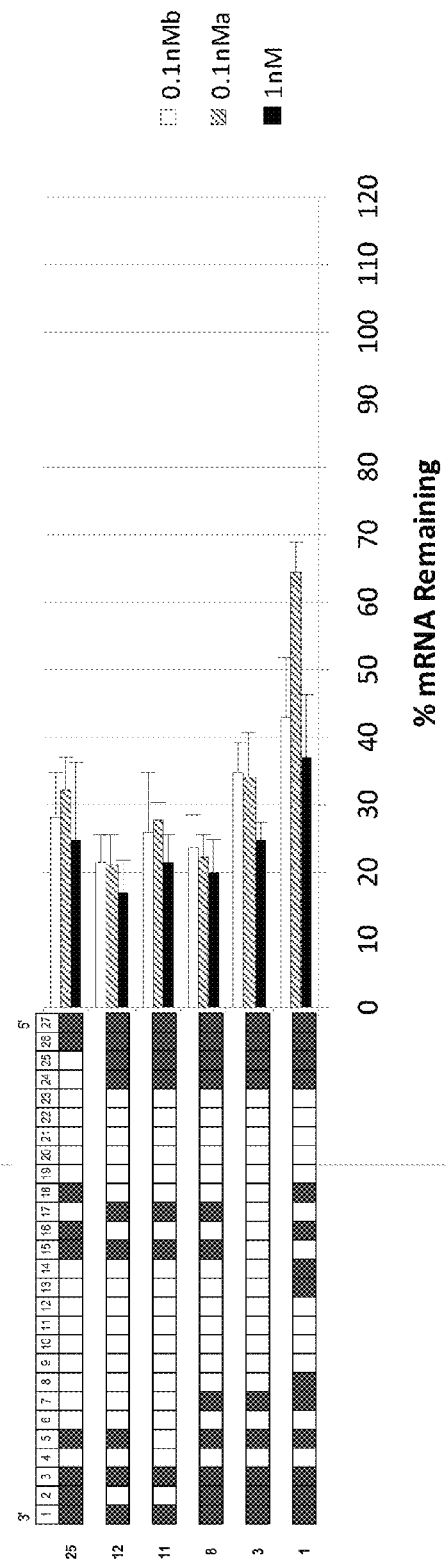
Figures 7, 8, 9, 10, 11, 12, 13, 14, 15, 16:
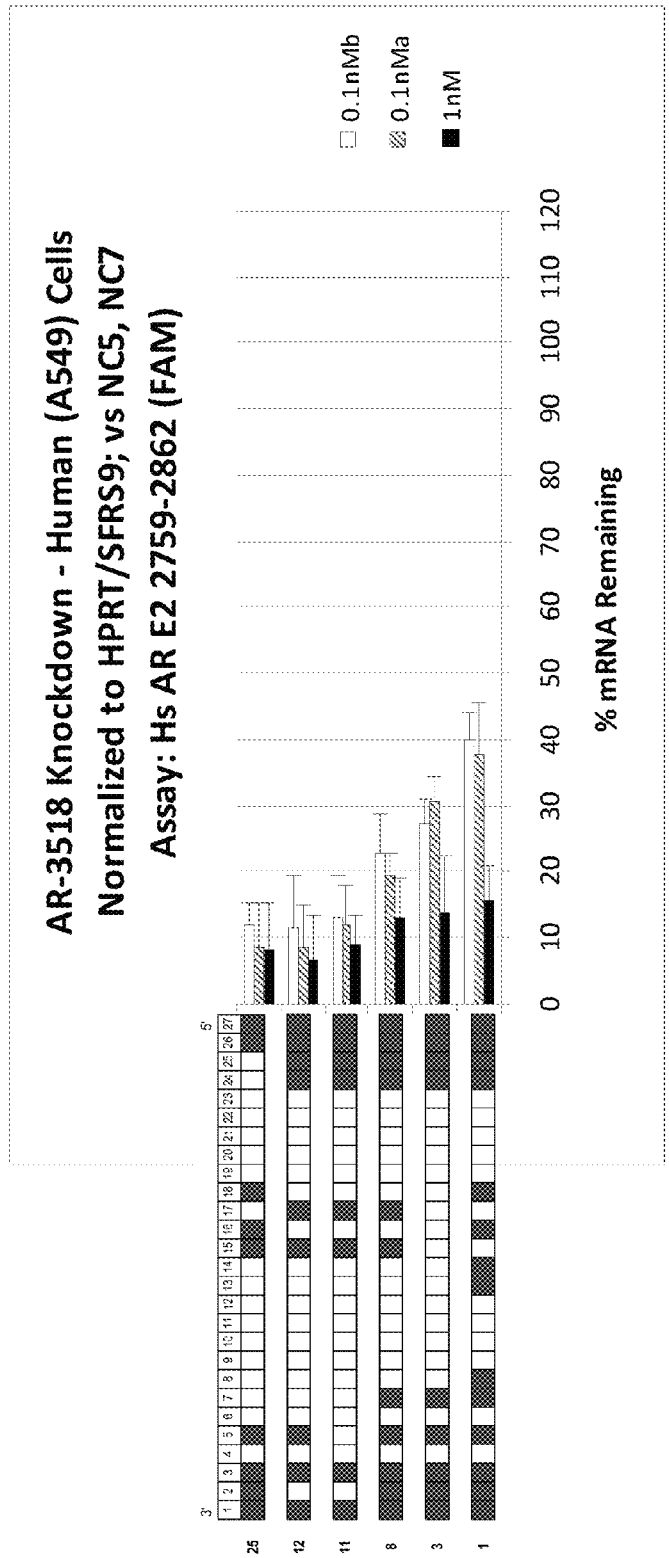
Figures 7, 8, 9, 10, 11, 12, 13, 14, 15, 16, 17:
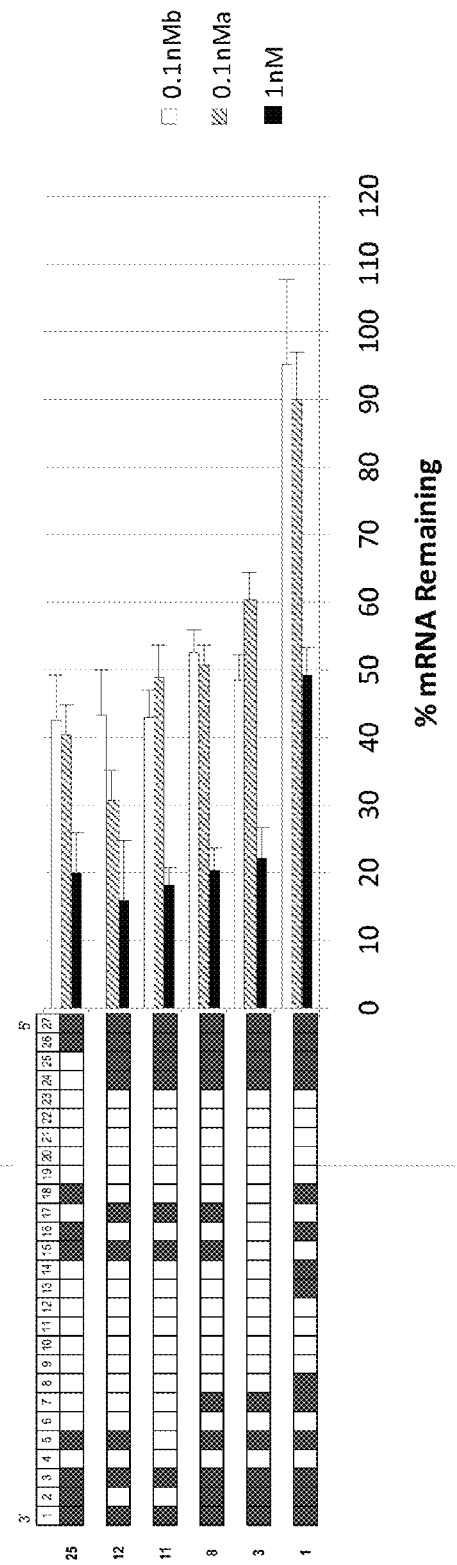
Figures 7, 8, 9, 10, 11, 12, 13, 14, 15, 16, 17, 18:
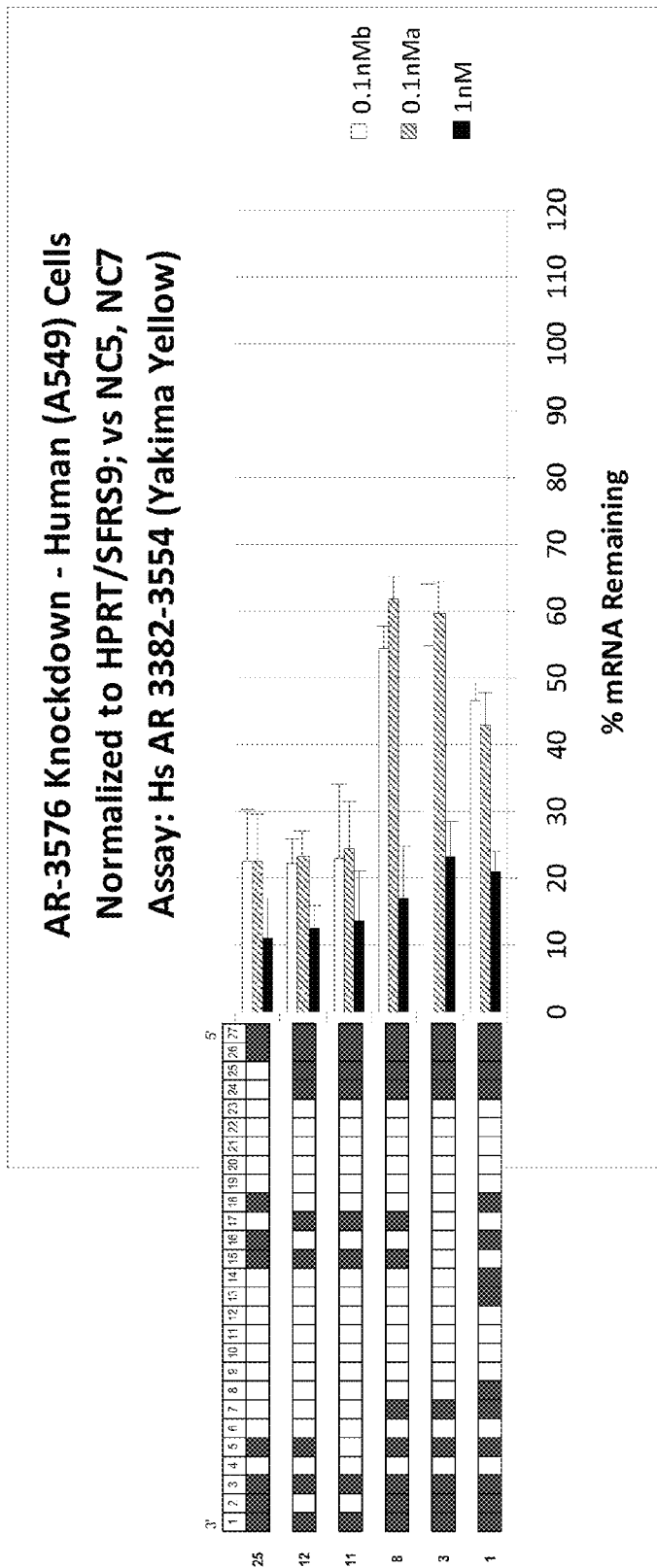
Figures 7, 8, 9, 10, 11, 12, 13, 14, 15, 16, 17, 18, 19:
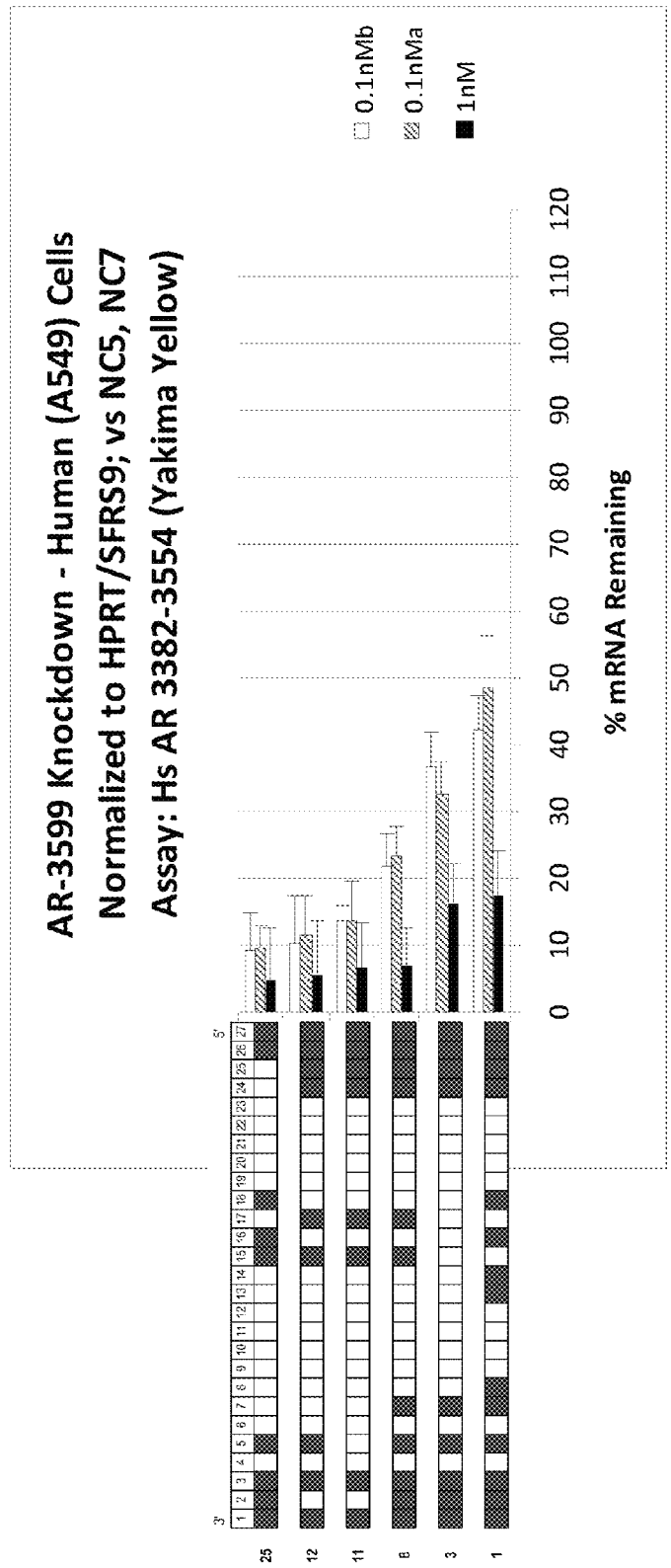
Figures 7, 8, 9, 10, 11, 12, 13, 14, 15, 16, 17, 18, 19, 20:
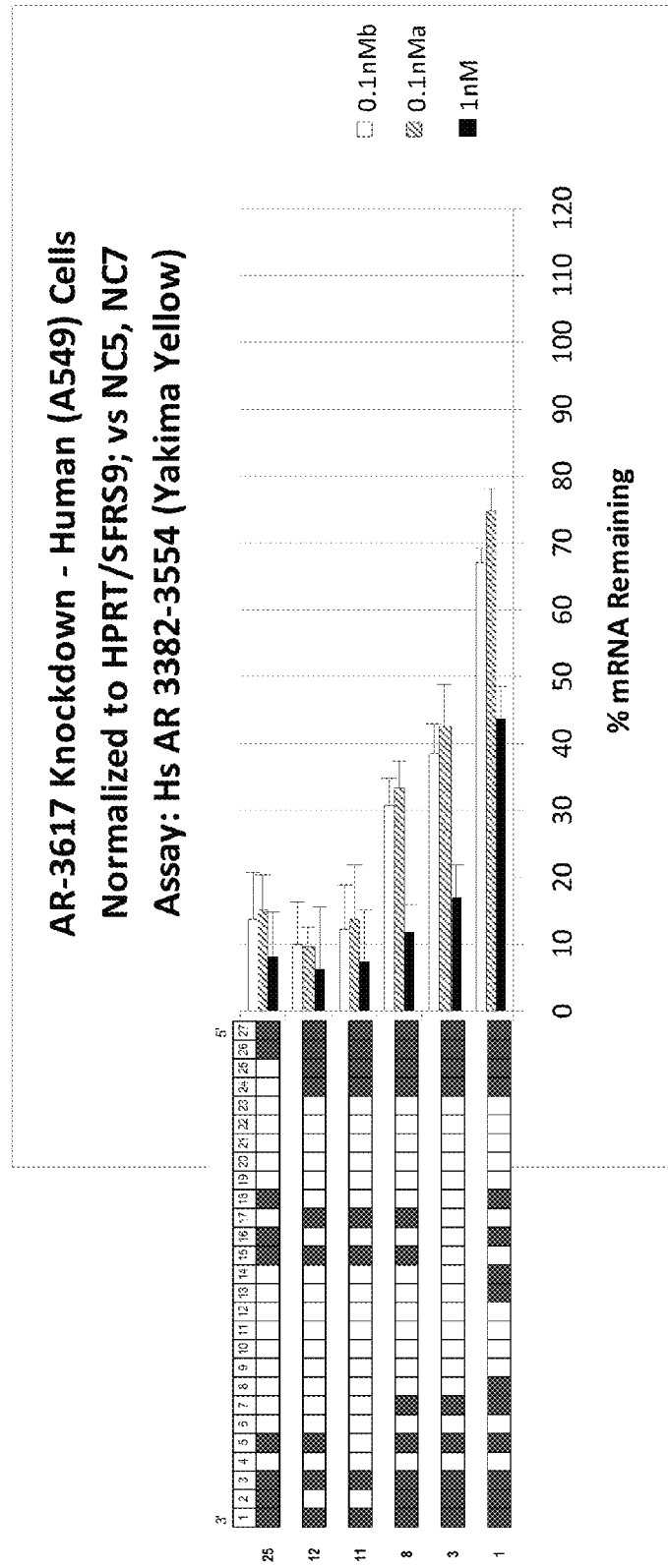
Figures 7, 8, 9, 10, 11, 12, 13, 14, 15, 16, 17, 18, 19, 20, 21:
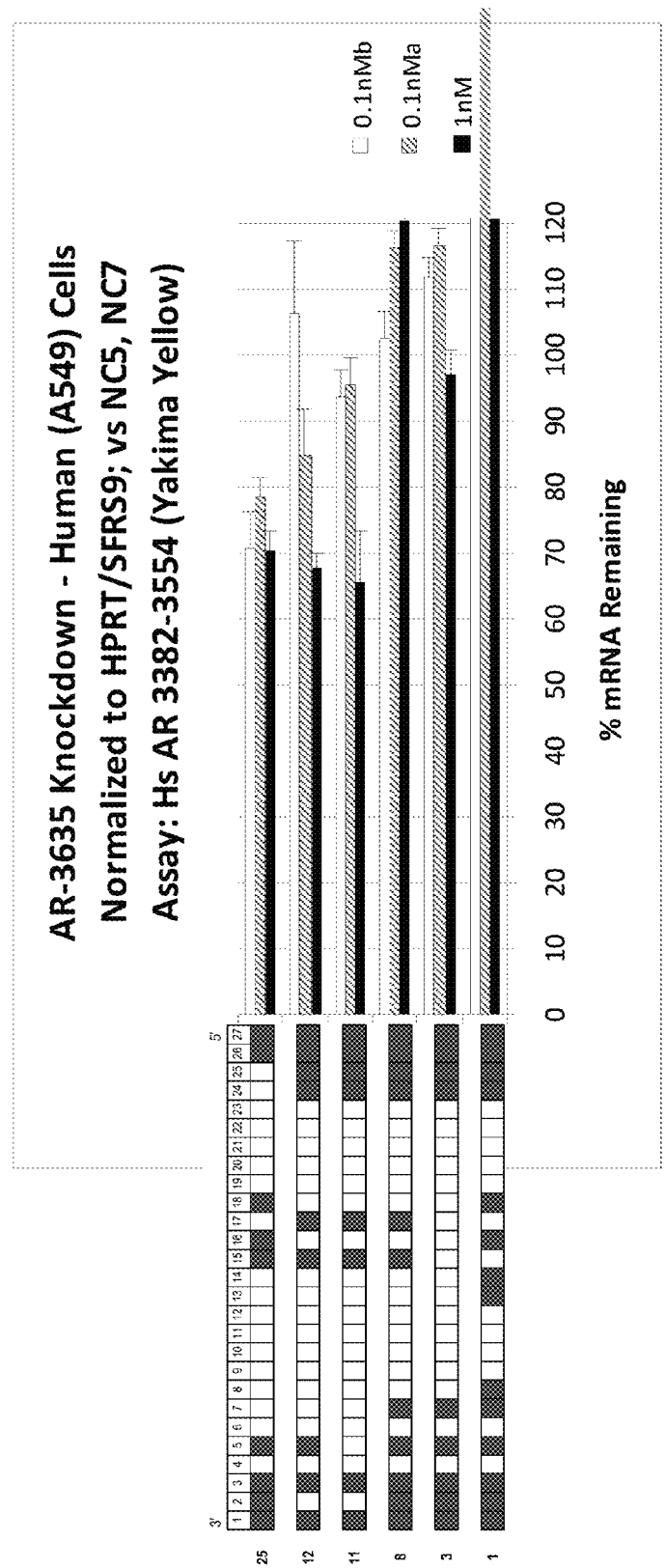
Figures 7, 8, 9, 10, 11, 12, 13, 14, 15, 16, 17, 18, 19, 20, 21, 22:
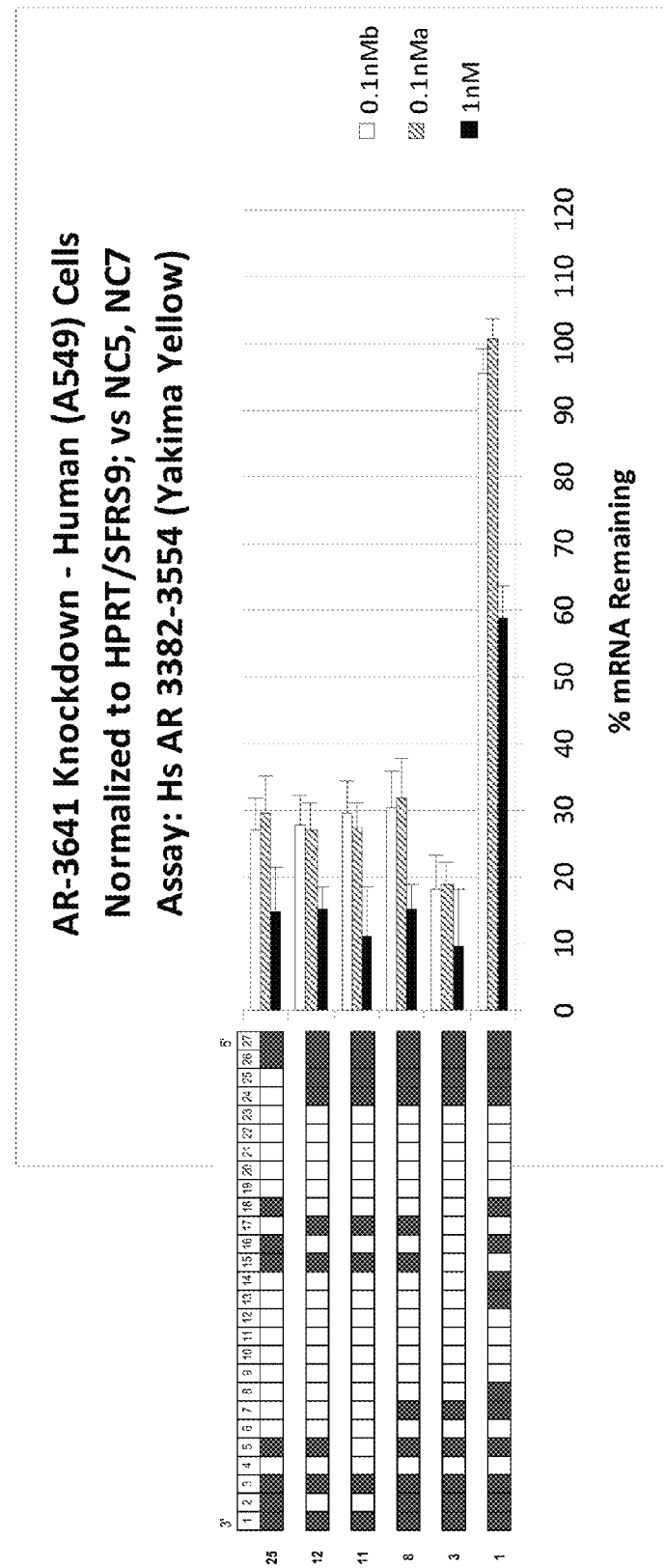
Figures 7, 8, 9, 10, 11, 12, 13, 14, 15, 16, 17, 18, 19, 20, 21, 22, 23:
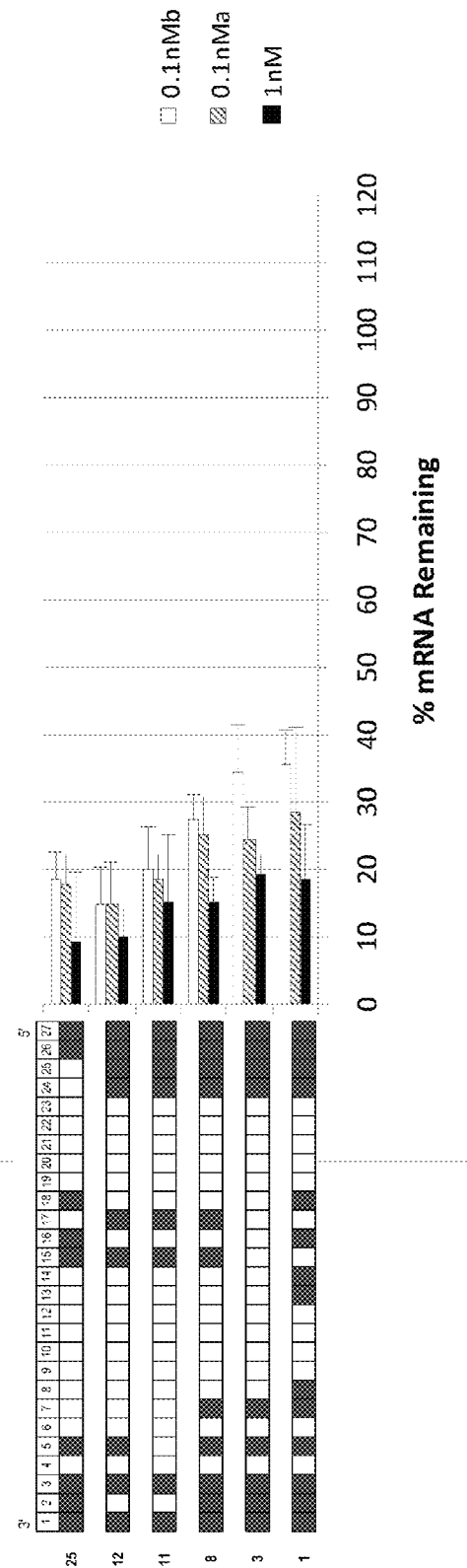
Figures 7, 8, 9, 10, 11, 12, 13, 14, 15, 16, 17, 18, 19, 20, 21, 22, 23, 24:
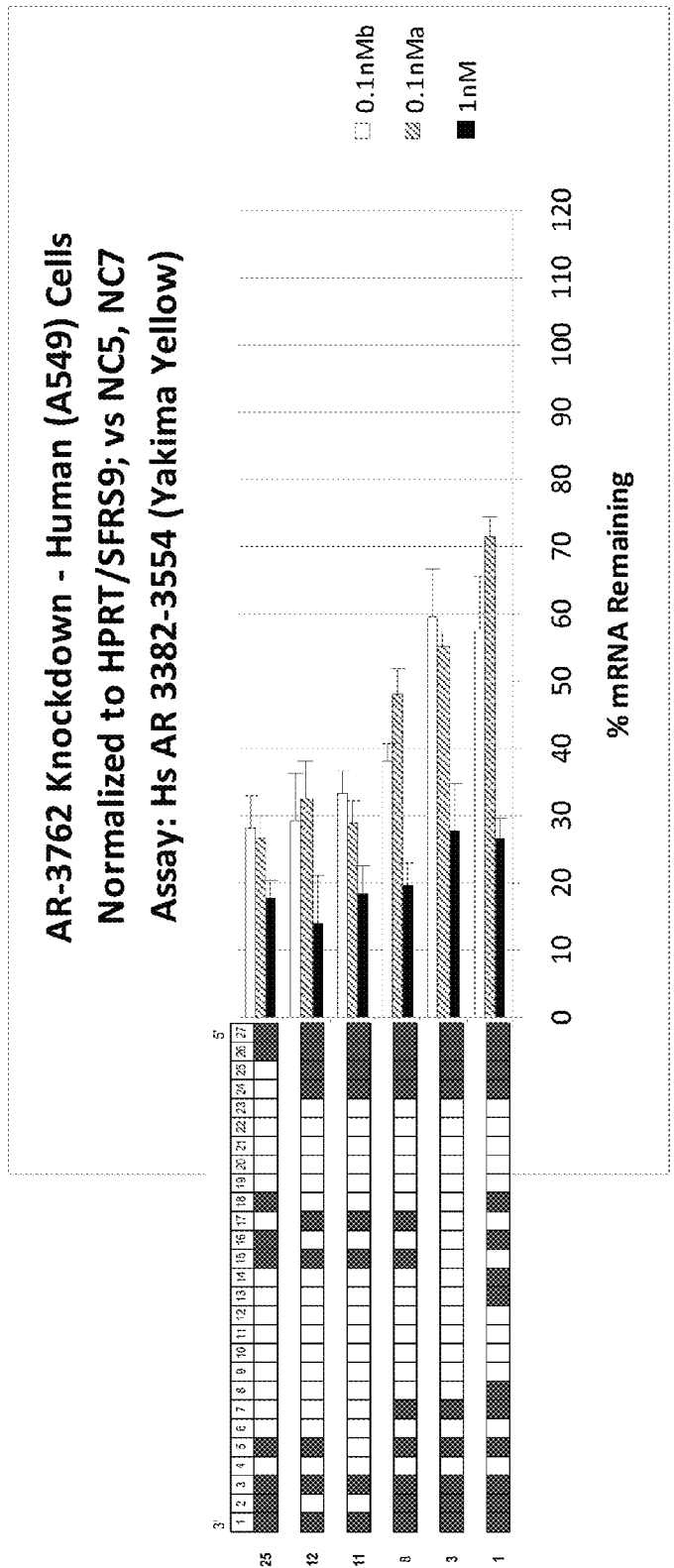
Figures 7, 8, 9, 10, 11, 12, 13, 14, 15, 16, 17, 18, 19, 20, 21, 22, 23, 24, 25:
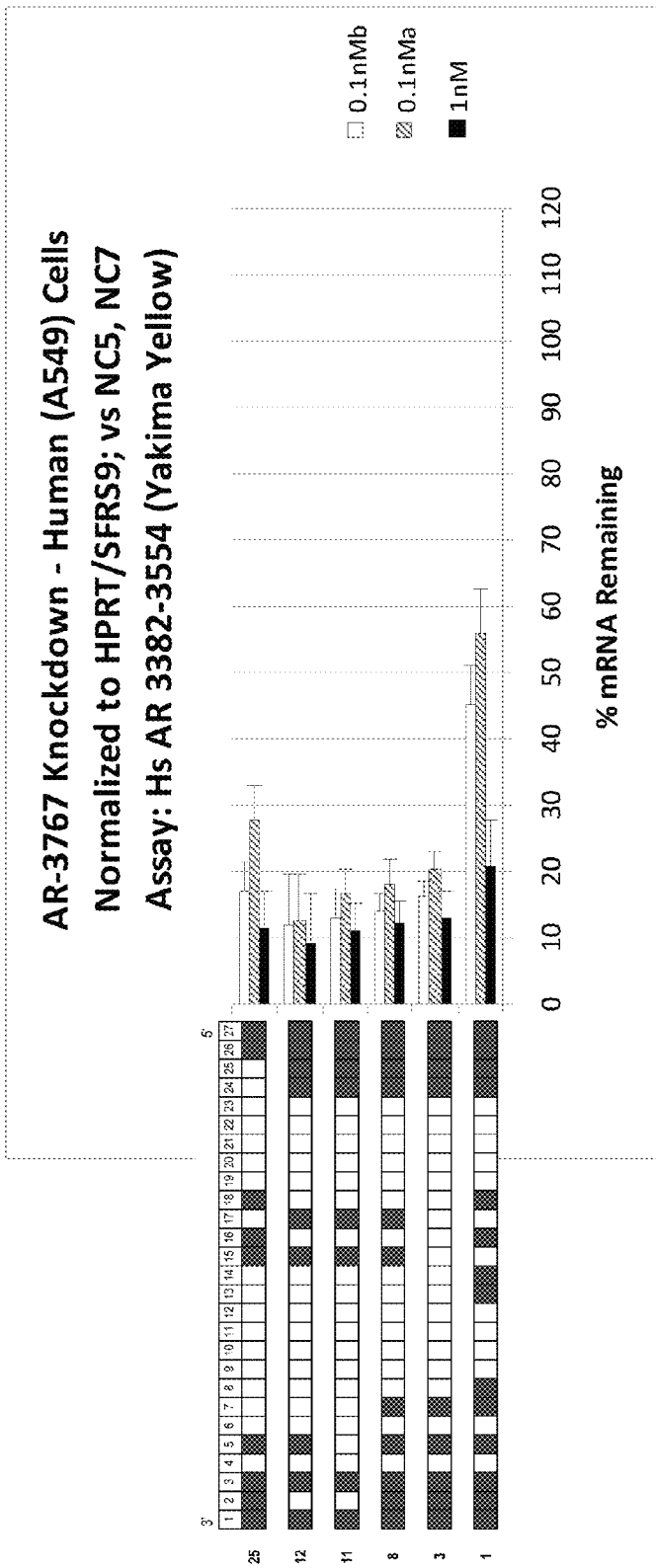
Figures 7, 8, 9, 10, 11, 12, 13, 14, 15, 16, 17, 18, 19, 20, 21, 22, 23, 24, 25, 26:
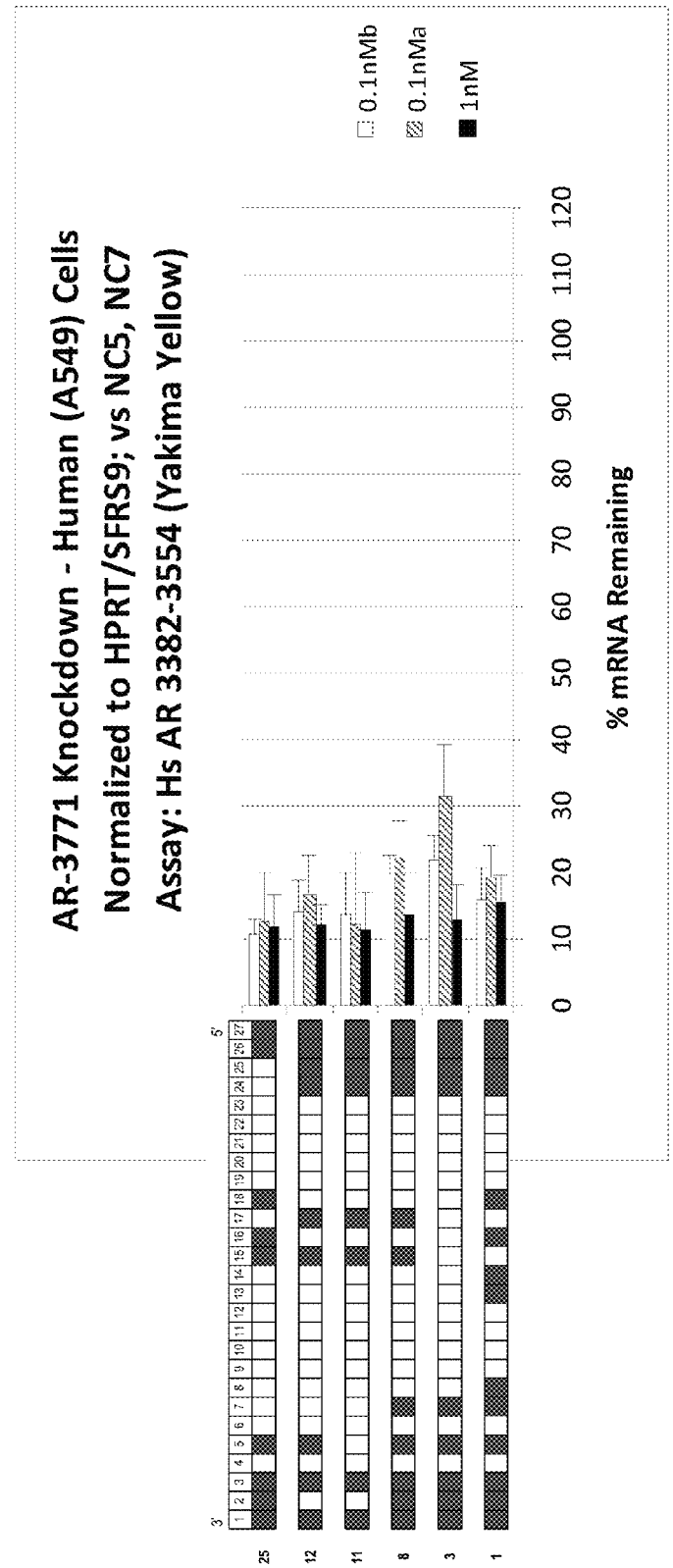
Figures 7, 8, 9, 10, 11, 12, 13, 14, 15, 16, 17, 18, 19, 20, 21, 22, 23, 24, 25, 26, 27:
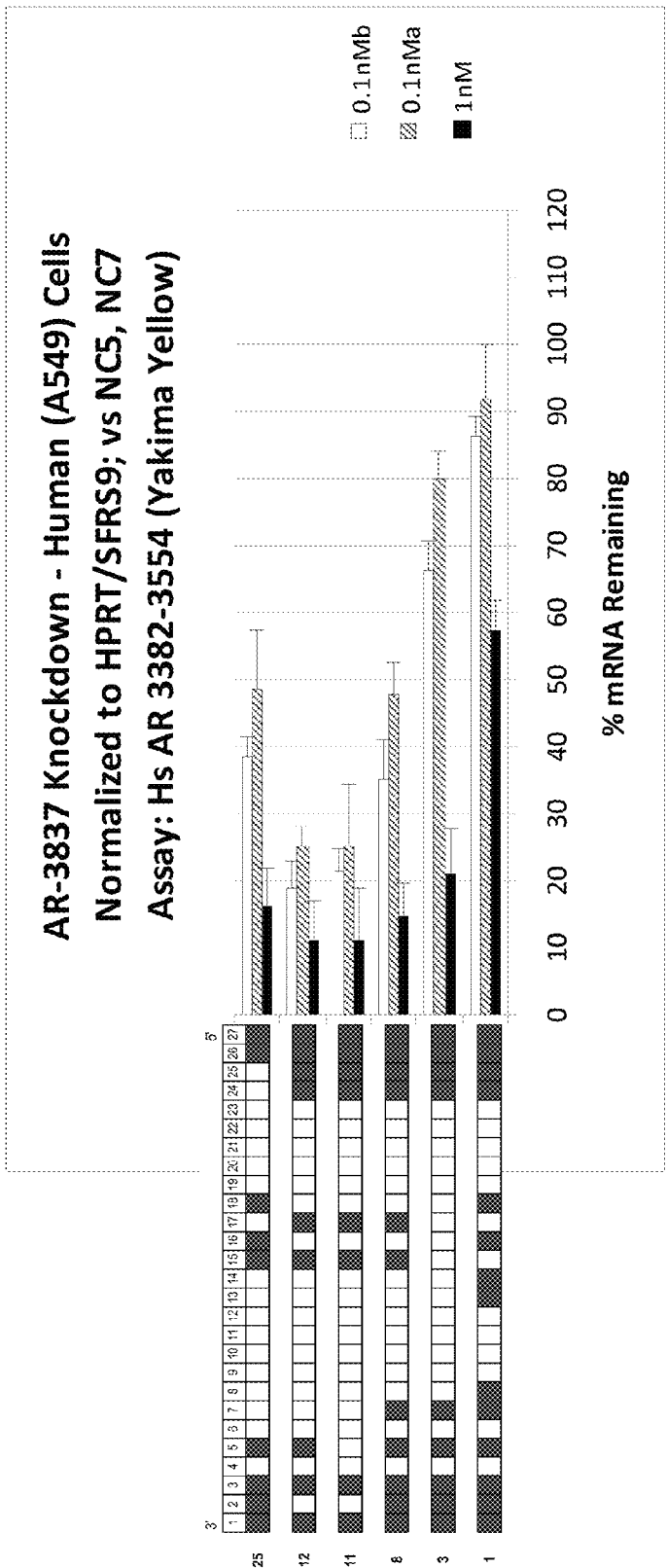
Figures 7, 8, 9, 10, 11, 12, 13, 14, 15, 16, 17, 18, 19, 20, 21, 22, 23, 24, 25, 26, 27, 28:
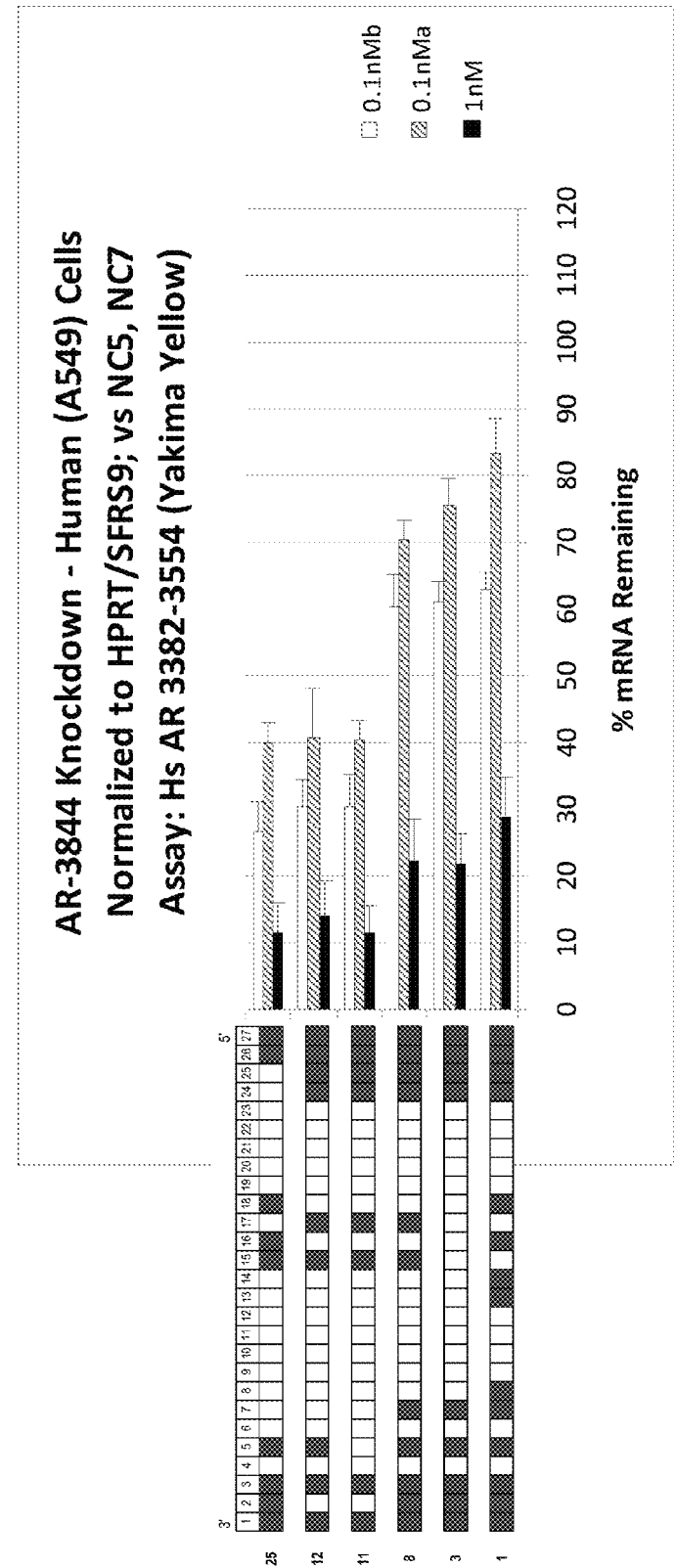
Figures 7, 8, 9, 10, 11, 12, 13, 14, 15, 16, 17, 18, 19, 20, 21, 22, 23, 24, 25, 26, 27, 28, 29:
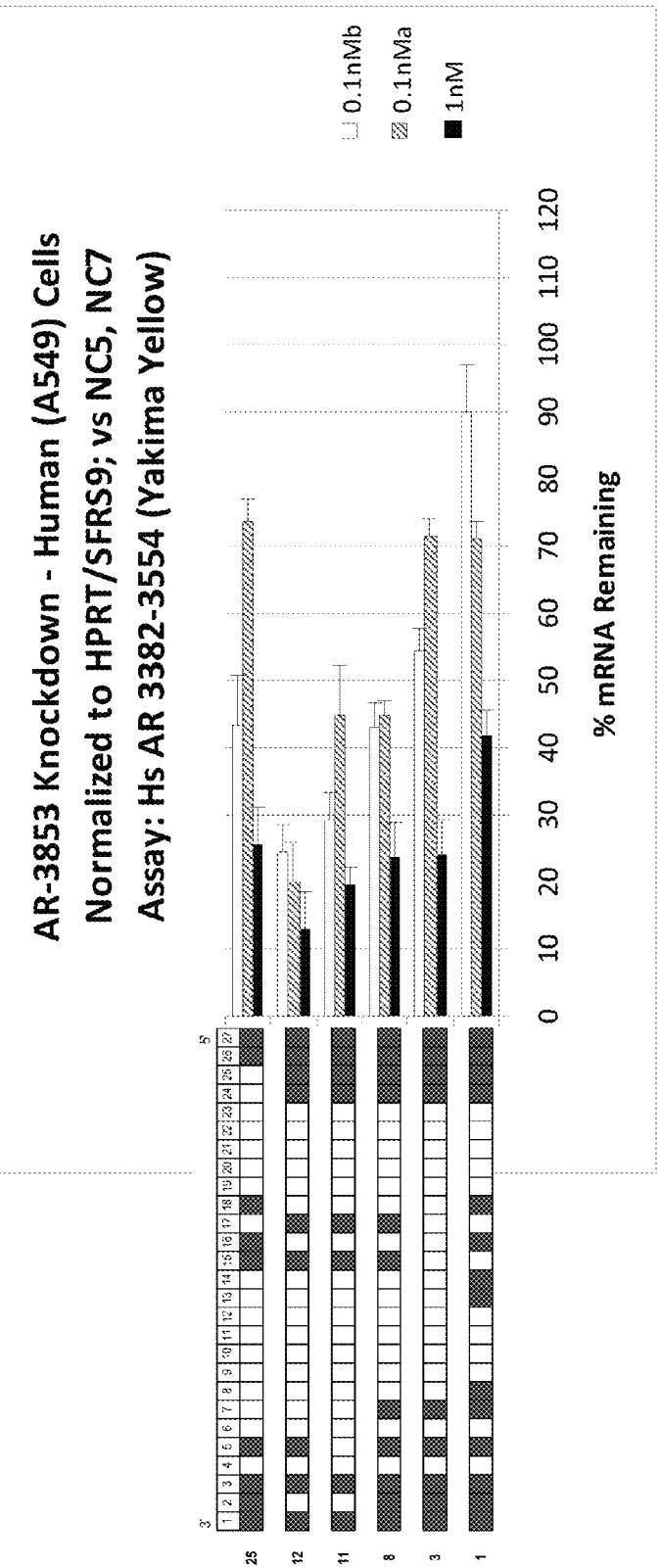
Figures 7, 8, 9, 10, 11, 12, 13, 14, 15, 16, 17, 18, 19, 20, 21, 22, 23, 24, 25, 26, 27, 28, 29, 30:
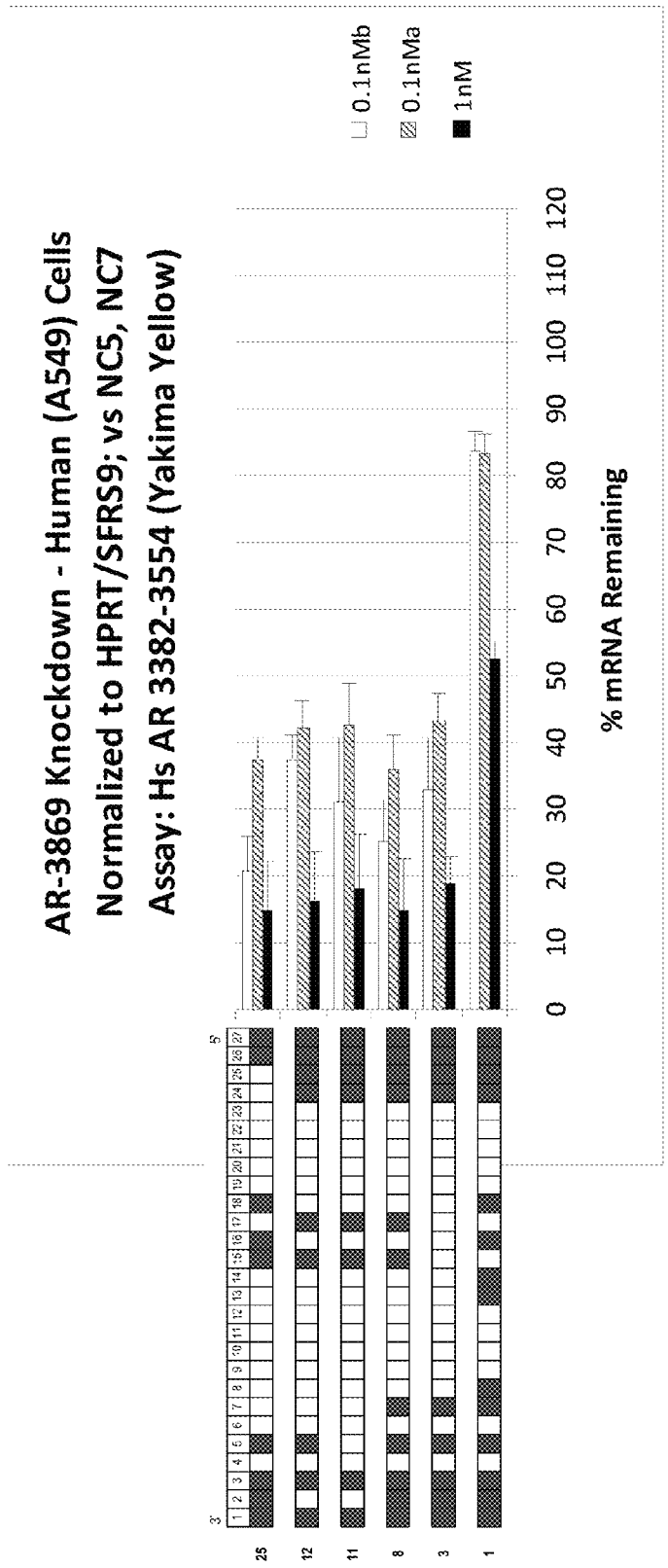
Figures 7, 8, 9, 10, 11, 12, 13, 14, 15, 16, 17, 18, 19, 20, 21, 22, 23, 24, 25, 26, 27, 28, 29, 30, 31:
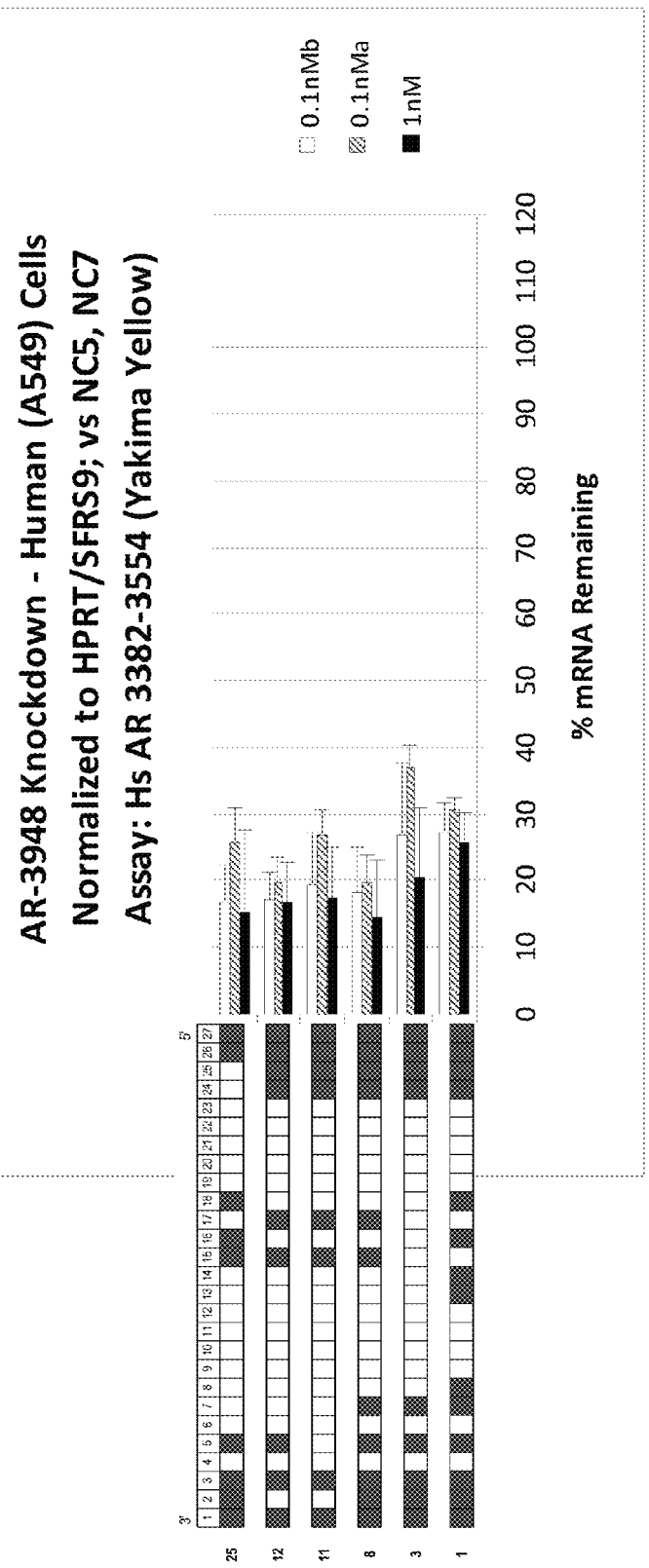
Figures 7, 8, 9, 10, 11, 12, 13, 14, 15, 16, 17, 18, 19, 20, 21, 22, 23, 24, 25, 26, 27, 28, 29, 30, 31, 32:
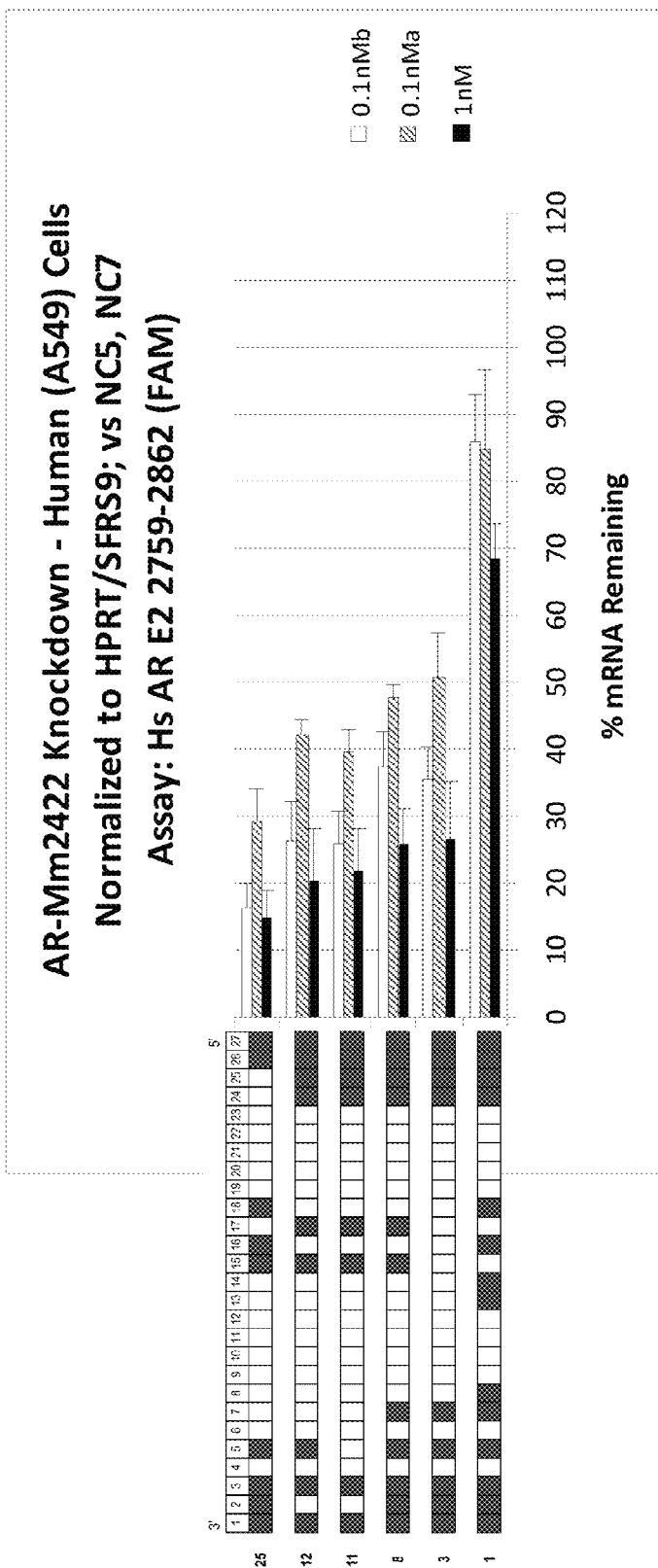
Figure 8:
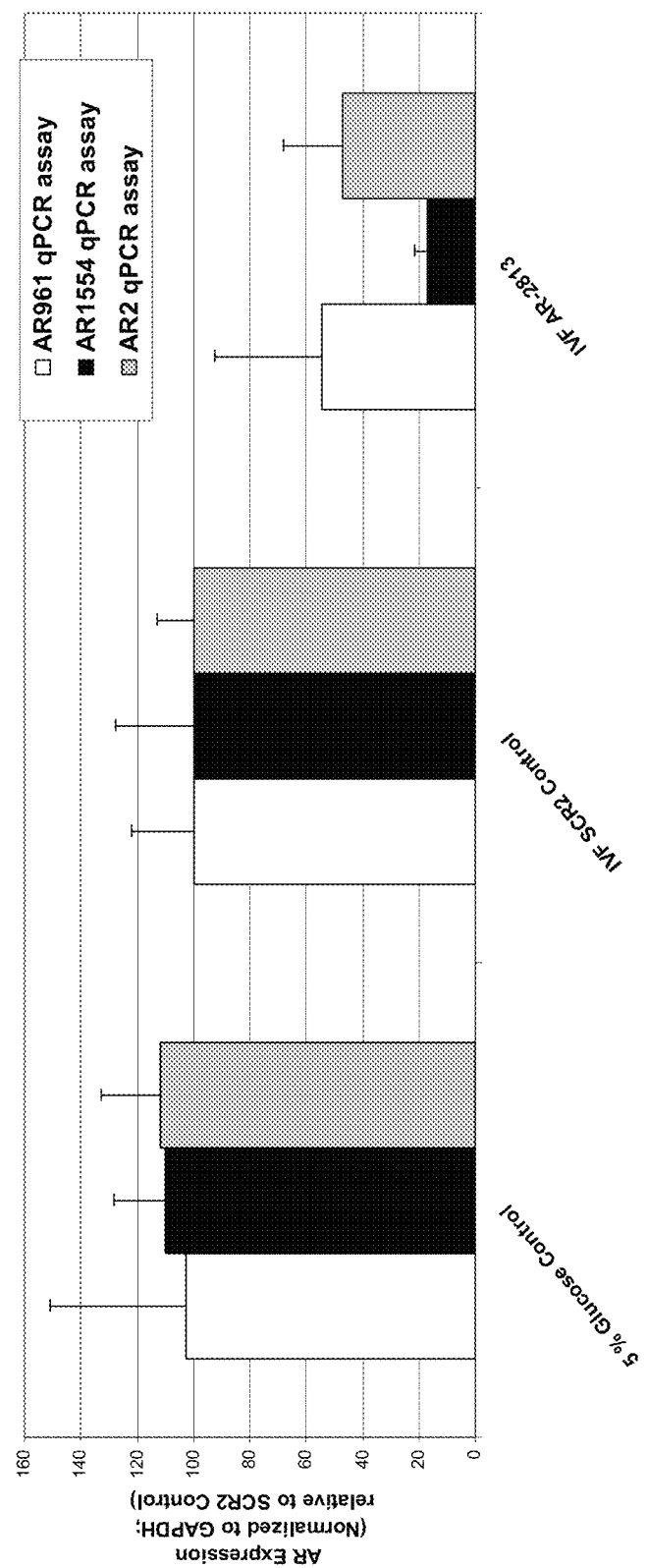
Figure 9:
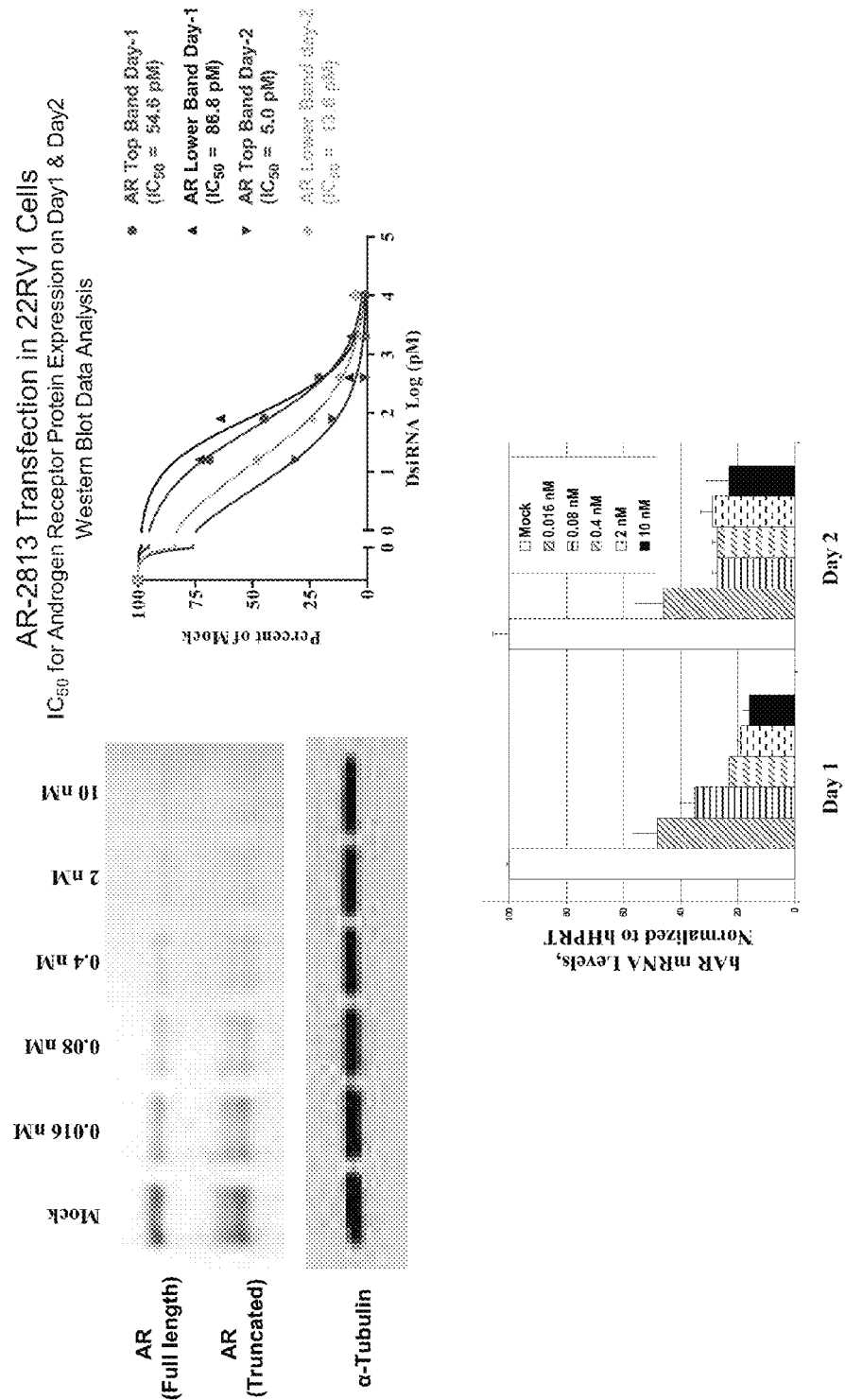
Figure 10:
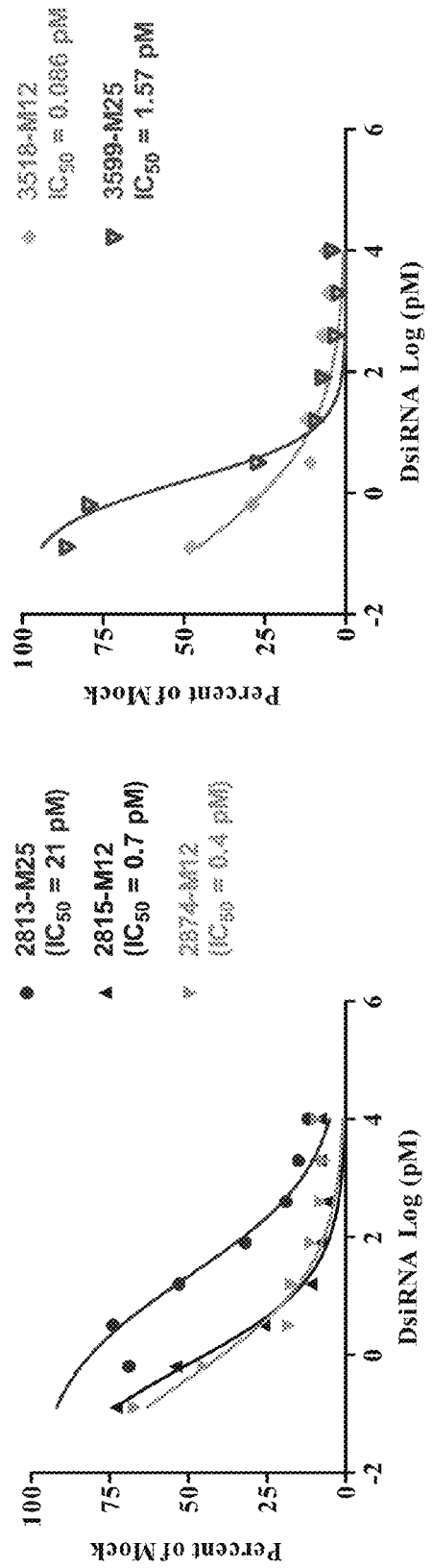
Figure 11:
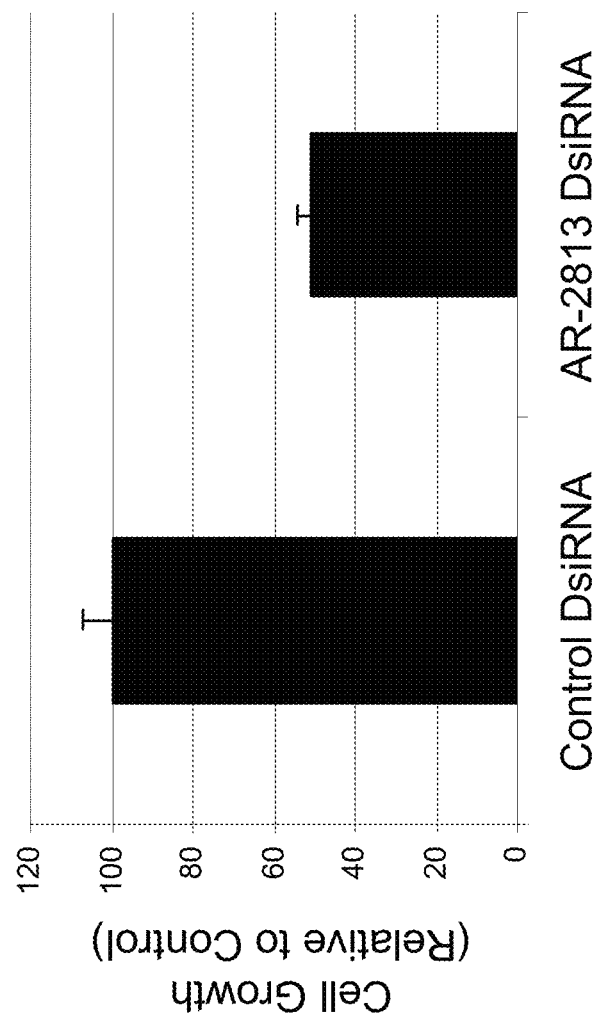
Figure 12:
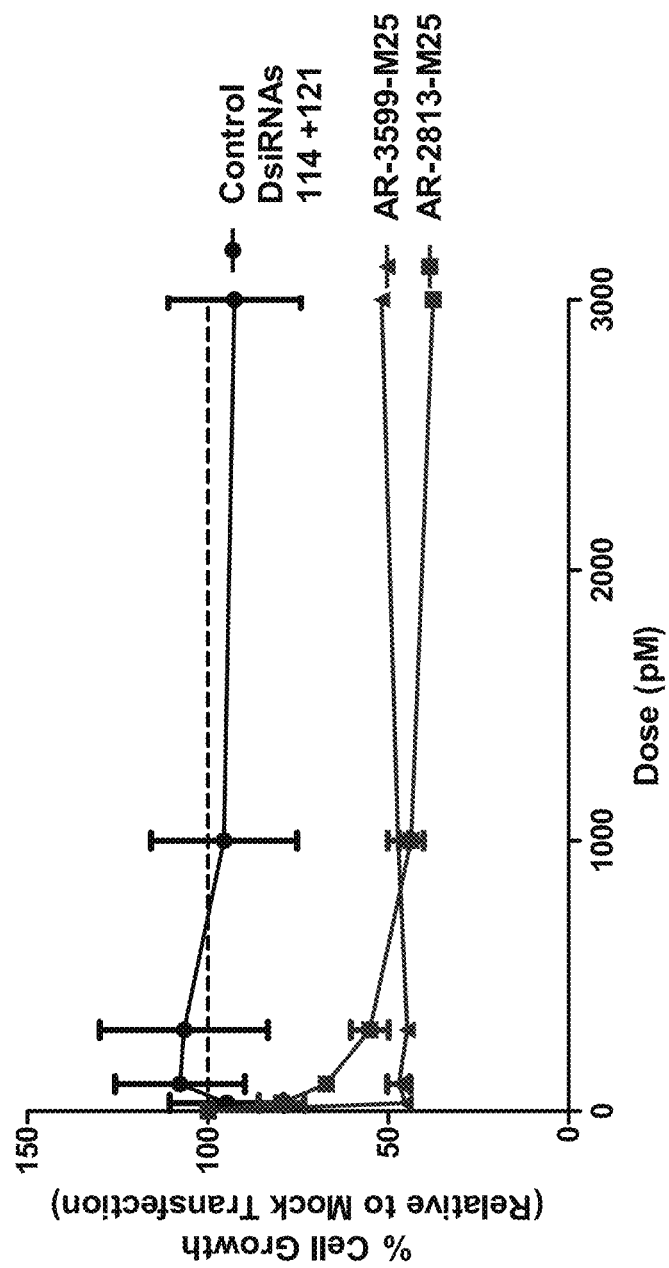
Figure 13:
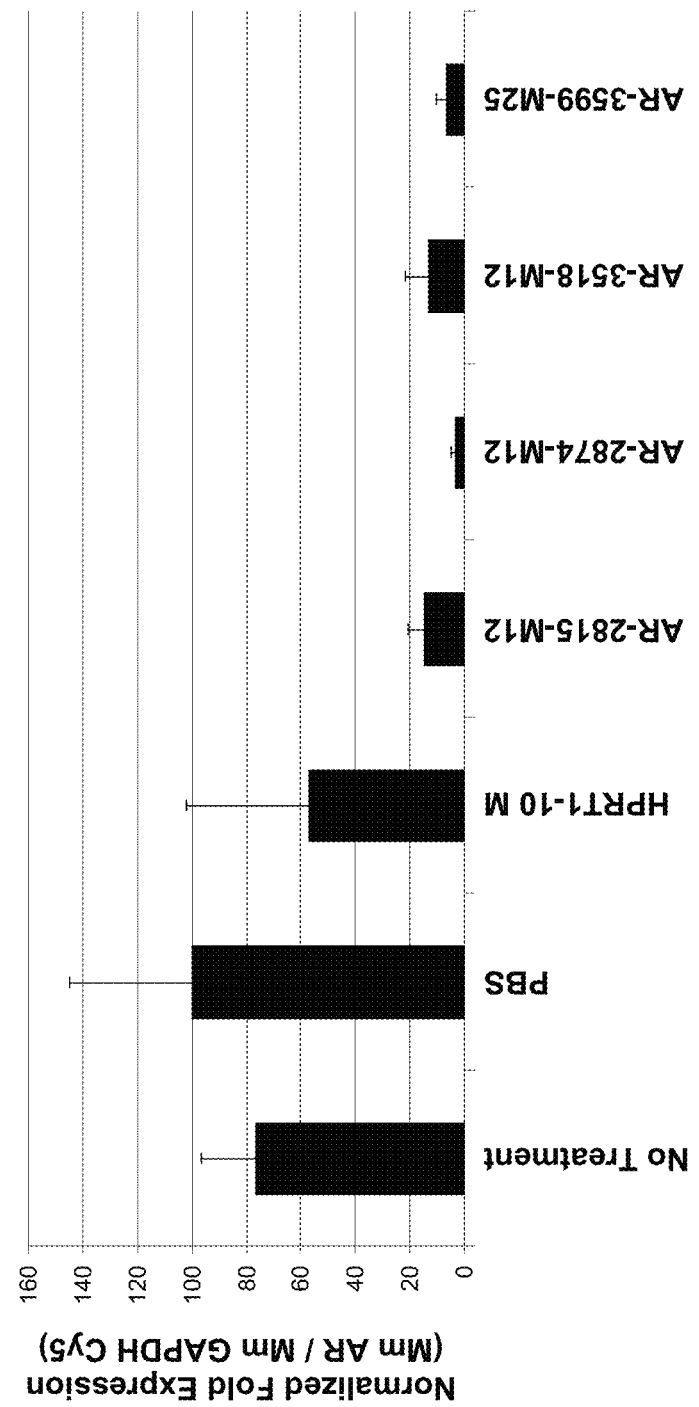
Figure 14:
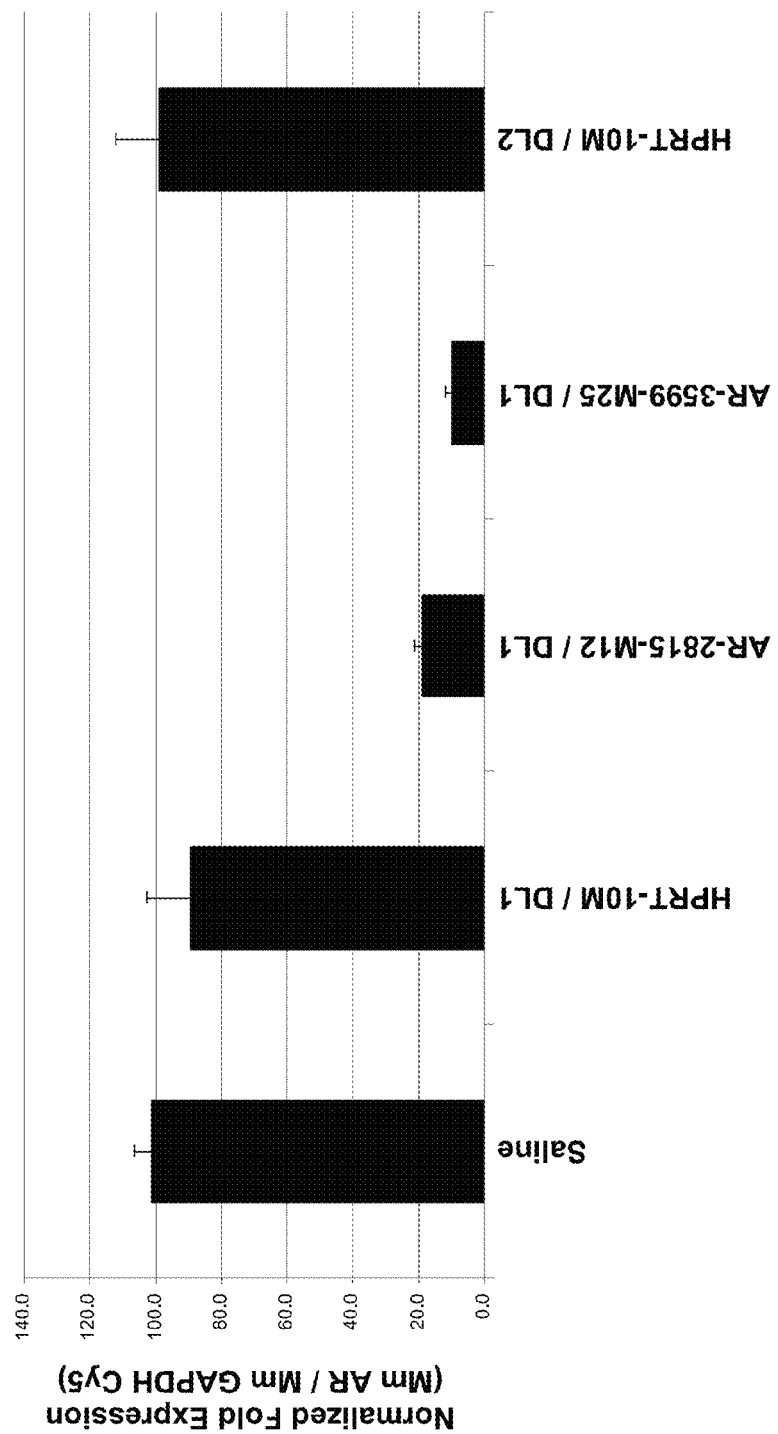

To confirm that in vivo knockdown results could be achieved with lipid formulations other than the InVivo-Fectamine™ (InVitrogen) transfection agent that was used to obtain the results shown in FIGS. 8 and 13, and to assess whether such formulations would inhibit AR expression in a transplanted tumor cell line in vivo, AR-targeting DsiRNAs were formulated in distinct lipid formulations "DL1" and "DL2", and such formulated DsiRNAs then assessed for in vivo knockdown of AR in transplanted tumor cells in liver and in normal liver tissue. Specifically, H460 tumors were implanted in mice subcutaneously and allowed to grow for two weeks. Three doses of 5 mg/kg iv were administered at 48 hour intervals, commencing when tumors were approximately ~300 mm³. DsiRNAs were formulated in lipid-based formulations DL1 or DL2. AR-targeting DsiRNAs AR2813-M12 and AR3599-M25 were tested in this study. Meanwhile, two additional groups of eight mice each (administered saline or an HPRT1 DsiRNA) were included in this study as control groups. Liver tissue was harvested 48 hrs after administration of the final dose, and was snap frozen. Frozen tissues were pulverized and a small portion of the liver tissues were homogenized in 500 µl of QIAzol lysis buffer, mixed with 500 µl of chloroform and were centrifuged. 100 µl of upper aqueous layer was transferred to SV 96 binding plate and RNA was extracted using an SV 96 Total RNA Isolation System (Promega). cDNA was made using a Transcriptor First Strand cDNA Synthesis Kit (Roche, using random primer and a heating step of 5' @70° C. qPCR was performed using iQ Multiplex Powermix (BIO-RAD) and corresponding primer probe sets from Applied Biosystems (TaqMan® Gene Expression Assays). GAPDH, a housekeeping gene was used as internal control for quantitation. As shown in FIG. 14, AR-targeting DsiRNAs (AR-2815-M12 and AR3599-M25) reduced AR mRNA expression in normal liver tissue by at least 80% (for AR3599-M25, by at least 90%) as compared to a saline- or control oligonucleotide-treated control.

Thus, AR-targeting DsiRNAs were shown to be potent and effective inhibitors of AR in liver tissue in vivo.

Example 12

Indications

The present body of knowledge in AR research indicates the need for methods to assay AR activity and for compounds that can regulate AR expression for research, diagnostic, and therapeutic use. As described herein, the nucleic acid molecules of the present invention can be used in assays to diagnose disease state related to AR levels. In addition, the nucleic acid molecules can be used to treat disease state related to AR misregulation, levels, etc.

Particular disorders and disease states that can be associated with AR expression modulation include, but are not limited to cancer and/or proliferative diseases, conditions, or disorders and other diseases, conditions or disorders that are related to or will respond to the levels of AR in a cell or tissue, alone or in combination with other therapies. Particular degenerative and disease states that are associated with AR expression modulation include but are not limited to, for example prostate cancer, lung cancer, colorectal cancer, bladder cancer, pancreatic cancer, and breast cancer.

Gemcytabine and cyclophosphamide are non-limiting examples of chemotherapeutic agents that can be combined with or used in conjunction with the nucleic acid molecules (e.g. DsiRNA molecules) of the instant invention. Those skilled in the art will recognize that other drugs such as anti-cancer compounds and therapies can be similarly be readily combined with the nucleic acid molecules of the instant invention (e.g. DsiRNA molecules) and are hence within the scope of the instant invention. Such compounds and therapies are well known in the art (see for example Cancer: Principles and Practice of Oncology, Volumes 1 and 2, eds Devita, V. T., Hellman, S., and Rosenberg, S. A., J. B. Lippincott Company, Philadelphia, USA) and include, without limitations, antifolates; fluoropyrimidines; cytarabine; purine analogs; adenosine analogs; amsacrine; topoisomerase I inhibitors; anthrapyrazoles; retinoids; antibiotics such as bleomycin, anthacyclins, mitomycin C, dactinomycin, and mithramycin; hexamethylmelamine; dacarbazine; l-asperginase; platinum analogs; alkylating agents such as nitrogen mustard, melphalan, chlorambucil, busulfan, ifosfamide, 4-hydroperoxycyclophosphamide, nitrosoureas, thiotepa; plant derived compounds such as vinca alkaloids, epipodophyllotoxins, taxol; Tamoxifen; radiation therapy; surgery; nutritional supplements; gene therapy; radiotherapy such as 3D-CRT; immunotoxin therapy such as ricin, monoclonal antibodies Herceptin; and the like. For combination therapy, the nucleic acids of the invention are prepared in one of two ways. First, the agents are physically combined in a preparation of nucleic acid and chemotherapeutic agent, such as a mixture of a nucleic acid of the invention encapsulated in liposomes and ifosfamide in a solution for intravenous administration, wherein both agents are present in a therapeutically effective concentration (e.g., ifosfamide in solution to deliver 1000-1250 mg/m2/day and liposome-associated nucleic acid of the invention in the same solution to deliver 0.1-100 mg/kg/day). Alternatively, the agents are administered separately but simultaneously in their respective effective doses (e.g., 1000-1250 mg/m2/d ifosfamide and 0.1 to 100 mg/kg/day nucleic acid of the invention).

Those skilled in the art will recognize that other compounds and therapies used to treat the diseases and conditions described herein can similarly be combined with the nucleic acid molecules of the instant invention (e.g. siNA molecules) and are hence within the scope of the instant invention.

Example 13

Serum Stability for DsiRNAs

Serum stability of DsiRNA agents is assessed via incubation of DsiRNA agents in 50% fetal bovine serum for various periods of time (up to 24 h) at 37° C. Serum is extracted and the nucleic acids are separated on a 20% non-denaturing PAGE and can be visualized with Gelstar stain. Relative levels of protection from nuclease degradation are assessed for DsiRNAs (optionally with and without modifications).

Example 14

Use of Additional Cell Culture Models to Evaluate the Down-Regulation of AR Gene Expression A variety of endpoints have been used in cell culture models to look at AR-mediated effects after treatment with anti-AR agents. Phenotypic endpoints include inhibition of cell proliferation, RNA expression, and reduction of AR protein expression. Because AR mutations are directly associated with increased proliferation of certain tumor cells, a proliferation endpoint for cell culture assays is can be used as a screen. There are several methods by which this endpoint can be measured. Following treatment of cells with DsiRNA, cells are allowed to grow (typically 5 days), after which the cell viability, the incorporation of bromodeoxyuridine (BrdU) into cellular DNA and/or the cell density are measured. The assay of cell density can be done in a 96-well format using commercially available fluorescent nucleic acid stains (such as Syto® 13 or CyQuant®). As a secondary, confirmatory endpoint, a DsiRNA-mediated decrease in the level of AR protein expression can be evaluated using an AR-specific ELISA.

Example 15

Evaluation of Anti-AR DsiRNA Efficacy in a Mouse Model of AR Misregulation

Anti-AR DsiRNA chosen from in vitro assays can be further tested in mouse models, including, e.g., xenograft and other animal models as recited above. In one example, mice possessing misregulated (e.g., elevated) AR levels are administered a DsiRNA agent of the present invention via hydrodynamic tail vein injection. 3-4 mice per group (divided based upon specific DsiRNA agent tested) are injected with 50 µg or 200 µg of DsiRNA. Levels of AR RNA are evaluated using RT-qPCR. Additionally or alternatively, levels of AR (e.g., AR protein levels and/or cancer cell/tumor formation, growth or spread) can be evaluated using an art-recognized method, or phenotypes associated with misregulation of AR (e.g., tumor formation, growth, metastasis, etc.) are monitored (optionally as a proxy for measurement of AR transcript or AR protein levels). Active DsiRNA in such animal models can also be subsequently tested in combination with standard chemotherapies.

Example 16

Diagnostic Uses

The DsiRNA molecules of the invention can be used in a variety of diagnostic applications, such as in the identification of molecular targets (e.g., RNA) in a variety of applications, for example, in clinical, industrial, environmental, agricultural and/or research settings. Such diagnostic use of DsiRNA molecules involves utilizing reconstituted RNAi systems, for example, using cellular lysates or partially purified cellular lysates. DsiRNA molecules of this invention can be used as diagnostic tools to examine genetic drift and mutations within diseased cells. The close relationship between DsiRNA activity and the structure of the target AR RNA allows the detection of mutations in a region of the AR molecule, which alters the base-pairing and three-dimensional structure of the target AR RNA. By using multiple DsiRNA molecules described in this invention, one can map nucleotide changes, which are important to RNA structure and function in vitro, as well as in cells and tissues. Cleavage of target AR RNAs with DsiRNA molecules can be used to inhibit gene expression and define the role of specified gene products in the progression of an AR-associated disease or disorder. In this manner, other genetic targets can be defined as important mediators of the disease. These experiments will lead to better treatment of the disease progression by affording the possibility of combination therapies (e.g., multiple DsiRNA molecules targeted to different genes, DsiRNA molecules coupled with known small molecule inhibitors, or intermittent treatment with combinations of DsiRNA molecules and/or other chemical or biological molecules). Other in vitro uses of DsiRNA molecules of this invention are well known in the art, and include detection of the presence of RNAs associated with a disease or related condition. Such RNA is detected by determining the presence of a cleavage product after treatment with a DsiRNA using standard methodologies, for example, fluorescence resonance emission transfer (FRET).

In a specific example, DsiRNA molecules that cleave only wild-type or mutant or polymorphic forms of the target AR RNA are used for the assay. The first DsiRNA molecules (i.e., those that cleave only wild-type forms of target AR RNA) are used to identify wild-type AR RNA present in the sample and the second DsiRNA molecules (i.e., those that cleave only mutant or polymorphic forms of target RNA) are used to identify mutant or polymorphic AR RNA in the sample. As reaction controls, synthetic substrates of both wild-type and mutant or polymorphic AR RNA are cleaved by both DsiRNA molecules to demonstrate the relative DsiRNA efficiencies in the reactions and the absence of cleavage of the "non-targeted" AR RNA species. The cleavage products from the synthetic substrates also serve to generate size markers for the analysis of wild-type and mutant AR RNAs in the sample population. Thus, each analysis requires two DsiRNA molecules, two substrates and one unknown sample, which is combined into six reactions. The presence of cleavage products is determined using an RNase protection assay so that full-length and cleavage fragments of each AR RNA can be analyzed in one lane of a polyacrylamide gel. It is not absolutely required to quantify the results to gain insight into the expression of mutant or polymorphic AR RNAs and putative risk of AR-associated phenotypic changes in target cells. The expression of AR mRNA whose protein product is implicated in the development of the phenotype (i.e., disease related/associated) is adequate to establish risk. If probes of comparable specific activity are used for both transcripts, then a qualitative comparison of AR RNA levels is adequate and decreases the cost of the initial diagnosis. Higher mutant or polymorphic form to wild-type ratios are correlated with higher risk whether AR RNA levels are compared qualitatively or quantitatively.

All patents and publications mentioned in the specification are indicative of the levels of skill of those skilled in the art to which the invention pertains. All references cited in this disclosure are incorporated by reference to the same extent as if each reference had been incorporated by reference in its entirety individually.

One skilled in the art would readily appreciate that the present invention is well adapted to carry out the objects and obtain the ends and advantages mentioned, as well as those inherent therein. The methods and compositions described herein as presently representative of preferred embodiments are exemplary and are not intended as limitations on the scope of the invention. Changes therein and other uses will occur to those skilled in the art, which are encompassed within the spirit of the invention, are defined by the scope of the claims.

It will be readily apparent to one skilled in the art that varying substitutions and modifications can be made to the invention disclosed herein without departing from the scope and spirit of the invention. Thus, such additional embodiments are within the scope of the present invention and the following claims. The present invention teaches one skilled in the art to test various combinations and/or substitutions of chemical modifications described herein toward generating nucleic acid constructs with improved activity for mediating RNAi activity. Such improved activity can comprise improved stability, improved bioavailability, and/or improved activation of cellular responses mediating RNAi. Therefore, the specific embodiments described herein are not limiting and one skilled in the art can readily appreciate that specific combinations of the modifications described herein can be tested without undue experimentation toward identifying DsiRNA molecules with improved RNAi activity.

The invention illustratively described herein suitably can be practiced in the absence of any element or elements, limitation or limitations that are not specifically disclosed herein. Thus, for example, in each instance herein any of the terms "comprising", "consisting essentially of", and "consisting of" may be replaced with either of the other two terms. The terms and expressions which have been employed are used as terms of description and not of limitation, and there is no intention that in the use of such terms and expressions of excluding any equivalents of the features shown and described or portions thereof, but it is recognized that various modifications are possible within the scope of the invention claimed. Thus, it should be understood that although the present invention has been specifically disclosed by preferred embodiments, optional features, modification and variation of the concepts herein disclosed may be resorted to by those skilled in the art, and that such modifications and variations are considered to be within the scope of this invention as defined by the description and the appended claims.

In addition, where features or aspects of the invention are described in terms of Markush groups or other grouping of alternatives, those skilled in the art will recognize that the invention is also thereby described in terms of any individual member or subgroup of members of the Markush group or other group.

The use of the terms "a" and "an" and "the" and similar referents in the context of describing the invention (especially in the context of the following claims) are to be construed to cover both the singular and the plural, unless otherwise indicated herein or clearly contradicted by context. The terms "comprising," "having," "including," and "containing" are to be construed as open-ended terms (i.e., meaning "including, but not limited to,") unless otherwise noted. Recitation of ranges of values herein are merely intended to serve as a shorthand method of referring individually to each separate value falling within the range, unless otherwise indicated herein, and each separate value is incorporated into the specification as if it were individually recited herein. All methods described herein can be performed in any suitable order unless otherwise indicated herein or otherwise clearly contradicted by context. The use of any and all examples, or exemplary language (e.g., "such as") provided herein, is intended merely to better illuminate the invention and does not pose a limitation on the scope of the invention unless otherwise claimed. No language in the specification should be construed as indicating any non-claimed element as essential to the practice of the invention.

Embodiments of this invention are described herein, including the best mode known to the inventors for carrying out the invention. Variations of those embodiments may become apparent to those of ordinary skill in the art upon reading the foregoing description.

The inventors expect skilled artisans to employ such variations as appropriate, and the inventors intend for the invention to be practiced otherwise than as specifically described herein. Accordingly, this invention includes all modifications and equivalents of the subject matter recited in the claims appended hereto as permitted by applicable law. Moreover, any combination of the above-described elements in all possible variations thereof is encompassed by the invention unless otherwise indicated herein or otherwise clearly contradicted by context. Those skilled in the art will recognize, or be able to ascertain using no more than routine experimentation, many equivalents to the specific embodiments of the invention described herein. Such equivalents are intended to be encompassed by the following claims.

SEQUENCE LISTING (5317 sequences)

SEQ ID NO: 1 - DNA, 25 bp, Artificial Sequence
  Description of Artificial Sequence: Synthetic oligonucleotide
  Description of Combined DNA/RNA Molecule: Synthetic oligonucleotide
aaguuuuuaaaagcugcuaaagact

SEQ ID NO: 2 - DNA, 25 bp, Artificial Sequence
  Description of Artificial Sequence: Synthetic oligonucleotide
  Description of Combined DNA/RNA Molecule: Synthetic oligonucleotide
aguuuuuaaaagcugcuaaagactc

SEQ ID NO: 3 - DNA, 25 bp, Artificial Sequence
  Description of Artificial Sequence: Synthetic oligonucleotide
  Description of Combined DNA/RNA Molecule: Synthetic oligonucleotide
guuuuuaaaagcugcuaaagacucg

SEQ ID NO: 4 - DNA, 25 bp, Artificial Sequence
  Description of Artificial Sequence: Synthetic oligonucleotide
  Description of Combined DNA/RNA Molecule: Synthetic oligonucleotide
cggagccagagaucaaaagaugaaa

SEQ ID NO: 5 - DNA, 25 bp, Artificial Sequence
  Description of Artificial Sequence: Synthetic oligonucleotide
  Description of Combined DNA/RNA Molecule: Synthetic oligonucleotide
cagagaucaaaagaugaaaaggcag

SEQ ID NO: 6 - DNA, 25 bp, Artificial Sequence
  Description of Artificial Sequence: Synthetic oligonucleotide
  Description of Combined DNA/RNA Molecule: Synthetic oligonucleotide
agagaucaaaagaugaaaaggcagt

SEQ ID NO: 7 - DNA, 25 bp, Artificial Sequence
  Description of Artificial Sequence: Synthetic oligonucleotide
  Description of Combined DNA/RNA Molecule: Synthetic oligonucleotide
aaagaugaaaaggcagucagguctt

SEQ ID NO: 8 - DNA, 25 bp, Artificial Sequence
  Description of Artificial Sequence: Synthetic oligonucleotide
  Description of Combined DNA/RNA Molecule: Synthetic oligonucleotide
aagaugaaaaggcagucaggucutc

SEQ ID NO: 9 - DNA, 25 bp, Artificial Sequence
  Description of Artificial Sequence: Synthetic oligonucleotide
  Description of Combined DNA/RNA Molecule: Synthetic oligonucleotide
caggucuucaguagccaaaaaacaa

SEQ ID NO: 10 - DNA, 25 bp, Artificial Sequence
  Description of Artificial Sequence: Synthetic oligonucleotide
  Description of Combined DNA/RNA Molecule: Synthetic oligonucleotide
aggucuucaguagccaaaaaacaaa

SEQ ID NO: 11 - DNA, 25 bp, Artificial Sequence
  Description of Artificial Sequence: Synthetic oligonucleotide
  Description of Combined DNA/RNA Molecule: Synthetic oligonucleotide
guagccaaaaaacaaaacaaacaaa

SEQ ID NO: 12 - DNA, 25 bp, Artificial Sequence
  Description of Artificial Sequence: Synthetic oligonucleotide
  Description of Combined DNA/RNA Molecule: Synthetic oligonucleotide
caaaaaacaaaacaaacaaaaacaa

SEQ ID NO: 13 - DNA, 25 bp, Artificial Sequence
  Description of Artificial Sequence: Synthetic oligonucleotide
  Description of Combined DNA/RNA Molecule: Synthetic oligonucleotide
aaaaaacaaaacaaacaaaaacaaa

SEQ ID NO: 14 - DNA, 25 bp, Artificial Sequence
  Description of Artificial Sequence: Synthetic oligonucleotide
  Description of Combined DNA/RNA Molecule: Synthetic oligonucleotide
aaaacaaacaaaaacaaaaaagccg

SEQ ID NO: 15 - DNA, 25 bp, Artificial Sequence
  Description of Artificial Sequence: Synthetic oligonucleotide
  Description of Combined DNA/RNA Molecule: Synthetic oligonucleotide
caaaaacaaaaaagccgaaauaaaa

SEQ ID NO: 16 - DNA, 25 bp, Artificial Sequence
  Description of Artificial Sequence: Synthetic oligonucleotide
  Description of Combined DNA/RNA Molecule: Synthetic oligonucleotide
aaaaacaaaaaagccgaaauaaaag

SEQ ID NO: 17 - DNA, 25 bp, Artificial Sequence
  Description of Artificial Sequence: Synthetic oligonucleotide
  Description of Combined DNA/RNA Molecule: Synthetic oligonucleotide
aaaacaaaaaagccgaaauaaaaga

SEQ ID NO: 18 - DNA, 25 bp, Artificial Sequence
  Description of Artificial Sequence: Synthetic oligonucleotide
  Description of Combined DNA/RNA Molecule: Synthetic oligonucleotide
aaaaaagccgaaauaaaagaaaaag

SEQ ID NO: 19 - DNA, 25 bp, Artificial Sequence
  Description of Artificial Sequence: Synthetic oligonucleotide
  Description of Combined DNA/RNA Molecule: Synthetic oligonucleotide
aaaaagccgaaauaaaagaaaaaga

SEQ ID NO: 20 - DNA, 25 bp, Artificial Sequence
  Description of Artificial Sequence: Synthetic oligonucleotide
  Description of Combined DNA/RNA Molecule: Synthetic oligonucleotide
aaagccgaaauaaaagaaaaagata

SEQ ID NO: 21 - DNA, 25 bp, Artificial Sequence
  Description of Artificial Sequence: Synthetic oligonucleotide
  Description of Combined DNA/RNA Molecule: Synthetic oligonucleotide
cgaaauaaaagaaaaagauaauaac

SEQ ID NO: 22 - DNA, 25 bp, Artificial Sequence
  Description of Artificial Sequence: Synthetic oligonucleotide
  Description of Combined DNA/RNA Molecule: Synthetic oligonucleotide
gaaauaaaagaaaaagauaauaact

SEQ ID NO: 23 - DNA, 25 bp, Artificial Sequence
  Description of Artificial Sequence: Synthetic oligonucleotide
  Description of Combined DNA/RNA Molecule: Synthetic oligonucleotide
aaauaaaagaaaaagauaauaactc

SEQ ID NO: 24 - DNA, 25 bp, Artificial Sequence
  Description of Artificial Sequence: Synthetic oligonucleotide
  Description of Combined DNA/RNA Molecule: Synthetic oligonucleotide
gaaaaagauaauaacucaguucuta

SEQ ID NO: 25 - DNA, 25 bp, Artificial Sequence
  Description of Artificial Sequence: Synthetic oligonucleotide
  Description of Combined DNA/RNA Molecule: Synthetic oligonucleotide
aagauaauaacucaguucuuauutg

SEQ ID NO: 26 - DNA, 25 bp, Artificial Sequence
  Description of Artificial Sequence: Synthetic oligonucleotide
  Description of Combined DNA/RNA Molecule: Synthetic oligonucleotide
agauaauaacucaguucuuauuugc

SEQ ID NO: 27 - DNA, 25 bp, Artificial Sequence
  Description of Artificial Sequence: Synthetic oligonucleotide
  Description of Combined DNA/RNA Molecule: Synthetic oligonucleotide
auaauaacucaguucuuauuugcac

SEQ ID NO: 28 - DNA, 25 bp, Artificial Sequence
  Description of Artificial Sequence: Synthetic oligonucleotide
  Description of Combined DNA/RNA Molecule: Synthetic oligonucleotide
uaauaacucaguucuuauuugcacc

SEQ ID NO: 29 - DNA, 25 bp, Artificial Sequence
  Description of Artificial Sequence: Synthetic oligonucleotide
  Description of Combined DNA/RNA Molecule: Synthetic oligonucleotide
uuauuugcaccuacuucaguggaca

SEQ ID NO: 30 - DNA, 25 bp, Artificial Sequence
  Description of Artificial Sequence: Synthetic oligonucleotide
  Description of Combined DNA/RNA Molecule: Synthetic oligonucleotide
aguggacacugaauuuggaaggugg

SEQ ID NO: 31 - DNA, 25 bp, Artificial Sequence
  Description of Artificial Sequence: Synthetic oligonucleotide
  Description of Combined DNA/RNA Molecule: Synthetic oligonucleotide
cugaauuuggaagguggaggauutt

SEQ ID NO: 32 - DNA, 25 bp, Artificial Sequence
  Description of Artificial Sequence: Synthetic oligonucleotide
  Description of Combined DNA/RNA Molecule: Synthetic oligonucleotide
uggaagguggaggauuuuguuuutt

SEQ ID NO: 33 - DNA, 25 bp, Artificial Sequence
  Description of Artificial Sequence: Synthetic oligonucleotide
  Description of Combined DNA/RNA Molecule: Synthetic oligonucleotide
aagguggaggauuuuguuuuuuuct

SEQ ID NO: 34 - DNA, 25 bp, Artificial Sequence
  Description of Artificial Sequence: Synthetic oligonucleotide
  Description of Combined DNA/RNA Molecule: Synthetic oligonucleotide
gaggauuuuguuuuuuucuuuuaag

SEQ ID NO: 35 - DNA, 25 bp, Artificial Sequence
  Description of Artificial Sequence: Synthetic oligonucleotide
  Description of Combined DNA/RNA Molecule: Synthetic oligonucleotide
aggauuuuguuuuuuucuuuuaaga

SEQ ID NO: 36 - DNA, 25 bp, Artificial Sequence
  Description of Artificial Sequence: Synthetic oligonucleotide
  Description of Combined DNA/RNA Molecule: Synthetic oligonucleotide
gauuuuguuuuuuucuuuuaagatc

SEQ ID NO: 37 - DNA, 25 bp, Artificial Sequence
  Description of Artificial Sequence: Synthetic oligonucleotide
  Description of Combined DNA/RNA Molecule: Synthetic oligonucleotide
auuuuguuuuuuucuuuuaagauct

SEQ ID NO: 38 - DNA, 25 bp, Artificial Sequence
  Description of Artificial Sequence: Synthetic oligonucleotide
  Description of Combined DNA/RNA Molecule: Synthetic oligonucleotide
uuuuguuuuuuucuuuuaagauctg

SEQ ID NO: 39 - DNA, 25 bp, Artificial Sequence
  Description of Artificial Sequence: Synthetic oligonucleotide
  Description of Combined DNA/RNA Molecule: Synthetic oligonucleotide
uuuguuuuuuucuuuuaagaucugg

SEQ ID NO: 40 - DNA, 25 bp, Artificial Sequence
  Description of Artificial Sequence: Synthetic oligonucleotide
  Description of Combined DNA/RNA Molecule: Synthetic oligonucleotide
uuuuuuucuuuuaagaucugggcat

SEQ ID NO: 41 - DNA, 25 bp, Artificial Sequence
  Description of Artificial Sequence: Synthetic oligonucleotide
  Description of Combined DNA/RNA Molecule: Synthetic oligonucleotide
uuuuuucuuuuaagaucugggcatc

SEQ ID NO: 42 - DNA, 25 bp, Artificial Sequence
  Description of Artificial Sequence: Synthetic oligonucleotide
  Description of Combined DNA/RNA Molecule: Synthetic oligonucleotide
uaagaucugggcaucuuuugaauct

SEQ ID NO: 43 - DNA, 25 bp, Artificial Sequence
  Description of Artificial Sequence: Synthetic oligonucleotide
  Description of Combined DNA/RNA Molecule: Synthetic oligonucleotide
cuuuugaaucuacccuucaaguatt

SEQ ID NO: 44 - DNA, 25 bp, Artificial Sequence
  Description of Artificial Sequence: Synthetic oligonucleotide
  Description of Combined DNA/RNA Molecule: Synthetic oligonucleotide
uuuugaaucuacccuucaaguauta

SEQ ID NO: 45 - DNA, 25 bp, Artificial Sequence
  Description of Artificial Sequence: Synthetic oligonucleotide
  Description of Combined DNA/RNA Molecule: Synthetic oligonucleotide
uuugaaucuacccuucaaguauuaa

SEQ ID NO: 46 - DNA, 25 bp, Artificial Sequence
  Description of Artificial Sequence: Synthetic oligonucleotide
  Description of Combined DNA/RNA Molecule: Synthetic oligonucleotide
uugaaucuacccuucaaguauuaag

SEQ ID NO: 47 - DNA, 25 bp, Artificial Sequence
  Description of Artificial Sequence: Synthetic oligonucleotide
  Description of Combined DNA/RNA Molecule: Synthetic oligonucleotide
ugaaucuacccuucaaguauuaaga

SEQ ID NO: 48 - DNA, 25 bp, Artificial Sequence
  Description of Artificial Sequence: Synthetic oligonucleotide
  Description of Combined DNA/RNA Molecule: Synthetic oligonucleotide
aaguauuaagagacagacugugagc

SEQ ID NO: 49 - DNA, 25 bp, Artificial Sequence
  Description of Artificial Sequence: Synthetic oligonucleotide
  Description of Combined DNA/RNA Molecule: Synthetic oligonucleotide
uauuaagagacagacugugagccta

SEQ ID NO: 50 - DNA, 25 bp, Artificial Sequence
  Description of Artificial Sequence: Synthetic oligonucleotide
  Description of Combined DNA/RNA Molecule: Synthetic oligonucleotide
guugaacucuucugagcaagagaag

SEQ ID NO: 51 - DNA, 25 bp, Artificial Sequence
  Description of Artificial Sequence: Synthetic oligonucleotide
  Description of Combined DNA/RNA Molecule: Synthetic oligonucleotide
uugaacucuucugagcaagagaagg

SEQ ID NO: 52 - DNA, 25 bp, Artificial Sequence
  Description of Artificial Sequence: Synthetic oligonucleotide
  Description of Combined DNA/RNA Molecule: Synthetic oligonucleotide
aggauggaagugcaguuagggcugg

SEQ ID NO: 53 - DNA, 25 bp, Artificial Sequence
  Description of Artificial Sequence: Synthetic oligonucleotide
  Description of Combined DNA/RNA Molecule: Synthetic oligonucleotide
gaggagcuuuccagaaucuguucca

SEQ ID NO: 54 - DNA, 25 bp, Artificial Sequence
  Description of Artificial Sequence: Synthetic oligonucleotide
  Description of Combined DNA/RNA Molecule: Synthetic oligonucleotide
aggagcuuuccagaaucuguuccag

SEQ ID NO: 55 - DNA, 25 bp, Artificial Sequence
  Description of Artificial Sequence: Synthetic oligonucleotide
  Description of Combined DNA/RNA Molecule: Synthetic oligonucleotide
cugaccuuaaagacauccugagcga

SEQ ID NO: 56 - DNA, 25 bp, Artificial Sequence
  Description of Artificial Sequence: Synthetic oligonucleotide
  Description of Combined DNA/RNA Molecule: Synthetic oligonucleotide
caaggacaauuacuuagggggcact

SEQ ID NO: 57 - DNA, 25 bp, Artificial Sequence
  Description of Artificial Sequence: Synthetic oligonucleotide
  Description of Combined DNA/RNA Molecule: Synthetic oligonucleotide
aaggaguuguguaaggcagugucgg

SEQ ID NO: 58 - DNA, 25 bp, Artificial Sequence
  Description of Artificial Sequence: Synthetic oligonucleotide
  Description of Combined DNA/RNA Molecule: Synthetic oligonucleotide
cugaagauacugcugaguauucccc

SEQ ID NO: 59 - DNA, 25 bp, Artificial Sequence
  Description of Artificial Sequence: Synthetic oligonucleotide
  Description of Combined DNA/RNA Molecule: Synthetic oligonucleotide
cugaguauuccccuuucaagggagg

SEQ ID NO: 60 - DNA, 25 bp, Artificial Sequence
  Description of Artificial Sequence: Synthetic oligonucleotide
  Description of Combined DNA/RNA Molecule: Synthetic oligonucleotide
cuugugucaaaagcgaaaugggccc

SEQ ID NO: 61 - DNA, 25 bp, Artificial Sequence
  Description of Artificial Sequence: Synthetic oligonucleotide
  Description of Combined DNA/RNA Molecule: Synthetic oligonucleotide
uugugucaaaagcgaaaugggcccc

SEQ ID NO: 62 - DNA, 25 bp, Artificial Sequence
  Description of Artificial Sequence: Synthetic oligonucleotide
  Description of Combined DNA/RNA Molecule: Synthetic oligonucleotide
cauguuuugcccauugacuauuact

SEQ ID NO: 63 - DNA, 25 bp, Artificial Sequence
  Description of Artificial Sequence: Synthetic oligonucleotide
  Description of Combined DNA/RNA Molecule: Synthetic oligonucleotide
uguuuugcccauugacuauuacutt

SEQ ID NO: 64 - DNA, 25 bp, Artificial Sequence
  Description of Artificial Sequence: Synthetic oligonucleotide
  Description of Combined DNA/RNA Molecule: Synthetic oligonucleotide
guggagaugaagcuucuggguguca

SEQ ID NO: 65 - DNA, 25 bp, Artificial Sequence
  Description of Artificial Sequence: Synthetic oligonucleotide
  Description of Combined DNA/RNA Molecule: Synthetic oligonucleotide
aagggaaacagaaguaccugugcgc

SEQ ID NO: 66 - DNA, 25 bp, Artificial Sequence
  Description of Artificial Sequence: Synthetic oligonucleotide
  Description of Combined DNA/RNA Molecule: Synthetic oligonucleotide
agaaaugauugcacuauugauaaat

SEQ ID NO: 67 - DNA, 25 bp, Artificial Sequence
  Description of Artificial Sequence: Synthetic oligonucleotide
  Description of Combined DNA/RNA Molecule: Synthetic oligonucleotide
gaaaugauugcacuauugauaaatt

SEQ ID NO: 68 - DNA, 25 bp, Artificial Sequence
  Description of Artificial Sequence: Synthetic oligonucleotide
  Description of Combined DNA/RNA Molecule: Synthetic oligonucleotide
aaaugauugcacuauugauaaautc

SEQ ID NO: 69 - DNA, 25 bp, Artificial Sequence
  Description of Artificial Sequence: Synthetic oligonucleotide
  Description of Combined DNA/RNA Molecule: Synthetic oligonucleotide
augauugcacuauugauaaauuccg

SEQ ID NO: 70 - DNA, 25 bp, Artificial Sequence
  Description of Artificial Sequence: Synthetic oligonucleotide
  Description of Combined DNA/RNA Molecule: Synthetic oligonucleotide
ugauugcacuauugauaaauuccga

SEQ ID NO: 71 - DNA, 25 bp, Artificial Sequence
  Description of Artificial Sequence: Synthetic oligonucleotide
  Description of Combined DNA/RNA Molecule: Synthetic oligonucleotide
cuauugauaaauuccgaaggaaaaa

SEQ ID NO: 72 - DNA, 25 bp, Artificial Sequence
  Description of Artificial Sequence: Synthetic oligonucleotide
  Description of Combined DNA/RNA Molecule: Synthetic oligonucleotide
uauugauaaauuccgaaggaaaaat

SEQ ID NO: 73 - DNA, 25 bp, Artificial Sequence
  Description of Artificial Sequence: Synthetic oligonucleotide
  Description of Combined DNA/RNA Molecule: Synthetic oligonucleotide
auugauaaauuccgaaggaaaaatt

SEQ ID NO: 74 - DNA, 25 bp, Artificial Sequence
  Description of Artificial Sequence: Synthetic oligonucleotide
  Description of Combined DNA/RNA Molecule: Synthetic oligonucleotide
uugauaaauuccgaaggaaaaautg

SEQ ID NO: 75 - DNA, 25 bp, Artificial Sequence
  Description of Artificial Sequence: Synthetic oligonucleotide
  Description of Combined DNA/RNA Molecule: Synthetic oligonucleotide
ugauaaauuccgaaggaaaaauugt

SEQ ID NO: 76 - DNA, 25 bp, Artificial Sequence
  Description of Artificial Sequence: Synthetic oligonucleotide
  Description of Combined DNA/RNA Molecule: Synthetic oligonucleotide
auaaauuccgaaggaaaaauugucc

SEQ ID NO: 77 - DNA, 25 bp, Artificial Sequence
  Description of Artificial Sequence: Synthetic oligonucleotide
  Description of Combined DNA/RNA Molecule: Synthetic oligonucleotide
uaaauuccgaaggaaaaauugucca

SEQ ID NO: 78 - DNA, 25 bp, Artificial Sequence
  Description of Artificial Sequence: Synthetic oligonucleotide
  Description of Combined DNA/RNA Molecule: Synthetic oligonucleotide
aaggaaaaauuguccaucuugucgt

SEQ ID NO: 79 - DNA, 25 bp, Artificial Sequence
  Description of Artificial Sequence: Synthetic oligonucleotide
  Description of Combined DNA/RNA Molecule: Synthetic oligonucleotide
cuugucgucuucggaaauguuauga

SEQ ID NO: 80 - DNA, 25 bp, Artificial Sequence
  Description of Artificial Sequence: Synthetic oligonucleotide
  Description of Combined DNA/RNA Molecule: Synthetic oligonucleotide
gaaauguuaugaagcagggaugact

SEQ ID NO: 81 - DNA, 25 bp, Artificial Sequence
  Description of Artificial Sequence: Synthetic oligonucleotide
  Description of Combined DNA/RNA Molecule: Synthetic oligonucleotide
aauguuaugaagcagggaugacuct

SEQ ID NO: 82 - DNA, 25 bp, Artificial Sequence
  Description of Artificial Sequence: Synthetic oligonucleotide
  Description of Combined DNA/RNA Molecule: Synthetic oligonucleotide
cggaagcugaagaaacuugguaatc

SEQ ID NO: 83 - DNA, 25 bp, Artificial Sequence
  Description of Artificial Sequence: Synthetic oligonucleotide
  Description of Combined DNA/RNA Molecule: Synthetic oligonucleotide
gaagcugaagaaacuugguaauctg

SEQ ID NO: 84 - DNA, 25 bp, Artificial Sequence
  Description of Artificial Sequence: Synthetic oligonucleotide
  Description of Combined DNA/RNA Molecule: Synthetic oligonucleotide
ugaagaaacuugguaaucugaaact

SEQ ID NO: 85 - DNA, 25 bp, Artificial Sequence
  Description of Artificial Sequence: Synthetic oligonucleotide
  Description of Combined DNA/RNA Molecule: Synthetic oligonucleotide
gaagaaacuugguaaucugaaacta

SEQ ID NO: 86 - DNA, 25 bp, Artificial Sequence
  Description of Artificial Sequence: Synthetic oligonucleotide
  Description of Combined DNA/RNA Molecule: Synthetic oligonucleotide
aagaaacuugguaaucugaaacuac

SEQ ID NO: 87 - DNA, 25 bp, Artificial Sequence
  Description of Artificial Sequence: Synthetic oligonucleotide
  Description of Combined DNA/RNA Molecule: Synthetic oligonucleotide
gguaaucugaaacuacaggaggaag

SEQ ID NO: 88 - DNA, 25 bp, Artificial Sequence
  Description of Artificial Sequence: Synthetic oligonucleotide
  Description of Combined DNA/RNA Molecule: Synthetic oligonucleotide
cugaaacuacaggaggaaggagagg

SEQ ID NO: 89 - DNA, 25 bp, Artificial Sequence
  Description of Artificial Sequence: Synthetic oligonucleotide
  Description of Combined DNA/RNA Molecule: Synthetic oligonucleotide
caggaauuccugugcaugaaagcac

SEQ ID NO: 90 - DNA, 25 bp, Artificial Sequence
  Description of Artificial Sequence: Synthetic oligonucleotide
  Description of Combined DNA/RNA Molecule: Synthetic oligonucleotide
aggaauuccugugcaugaaagcact

SEQ ID NO: 91 - DNA, 25 bp, Artificial Sequence
  Description of Artificial Sequence: Synthetic oligonucleotide
  Description of Combined DNA/RNA Molecule: Synthetic oligonucleotide
ggaugggcugaaaaaucaaaaautc

SEQ ID NO: 92 - DNA, 25 bp, Artificial Sequence
  Description of Artificial Sequence: Synthetic oligonucleotide
  Description of Combined DNA/RNA Molecule: Synthetic oligonucleotide
gaugggcugaaaaaucaaaaauuct

SEQ ID NO: 93 - DNA, 25 bp, Artificial Sequence
  Description of Artificial Sequence: Synthetic oligonucleotide
  Description of Combined DNA/RNA Molecule: Synthetic oligonucleotide
ugggcugaaaaaucaaaaauucutt

SEQ ID NO: 94 - DNA, 25 bp, Artificial Sequence
  Description of Artificial Sequence: Synthetic oligonucleotide
  Description of Combined DNA/RNA Molecule: Synthetic oligonucleotide
cugaaaaaucaaaaauucuuugatg

SEQ ID NO: 95 - DNA, 25 bp, Artificial Sequence
  Description of Artificial Sequence: Synthetic oligonucleotide
  Description of Combined DNA/RNA Molecule: Synthetic oligonucleotide
ugaaaaaucaaaaauucuuugauga

SEQ ID NO: 96 - DNA, 25 bp, Artificial Sequence
  Description of Artificial Sequence: Synthetic oligonucleotide
  Description of Combined DNA/RNA Molecule: Synthetic oligonucleotide
aaaaaucaaaaauucuuugaugaac

SEQ ID NO: 97 - DNA, 25 bp, Artificial Sequence
  Description of Artificial Sequence: Synthetic oligonucleotide
  Description of Combined DNA/RNA Molecule: Synthetic oligonucleotide
aaaaucaaaaauucuuugaugaact

SEQ ID NO: 98 - DNA, 25 bp, Artificial Sequence
  Description of Artificial Sequence: Synthetic oligonucleotide
  Description of Combined DNA/RNA Molecule: Synthetic oligonucleotide
aaaucaaaaauucuuugaugaactt

SEQ ID NO: 99 - DNA, 25 bp, Artificial Sequence
  Description of Artificial Sequence: Synthetic oligonucleotide
  Description of Combined DNA/RNA Molecule: Synthetic oligonucleotide
cgaaugaacuacaucaaggaacucg

SEQ ID NO: 100 - DNA, 25 bp, Artificial Sequence
  Description of Artificial Sequence: Synthetic oligonucleotide
  Description of Combined DNA/RNA Molecule: Synthetic oligonucleotide
aaggaacucgaucguaucauugcat

SEQ ID NO: 101 - DNA, 25 bp, Artificial Sequence
  Description of Artificial Sequence: Synthetic oligonucleotide
  Description of Combined DNA/RNA Molecule: Synthetic oligonucleotide
aggaacucgaucguaucauugcatg

SEQ ID NO: 102 - DNA, 25 bp, Artificial Sequence
  Description of Artificial Sequence: Synthetic oligonucleotide
  Description of Combined DNA/RNA Molecule: Synthetic oligonucleotide
cguaucauugcaugcaaaagaaaaa

SEQ ID NO: 103 - DNA, 25 bp, Artificial Sequence
  Description of Artificial Sequence: Synthetic oligonucleotide
  Description of Combined DNA/RNA Molecule: Synthetic oligonucleotide
guaucauugcaugcaaaagaaaaaa

SEQ ID NO: 104 - DNA, 25 bp, Artificial Sequence
  Description of Artificial Sequence: Synthetic oligonucleotide
  Description of Combined DNA/RNA Molecule: Synthetic oligonucleotide
cauugcaugcaaaagaaaaaauccc

SEQ ID NO: 105 - DNA, 25 bp, Artificial Sequence
  Description of Artificial Sequence: Synthetic oligonucleotide
  Description of Combined DNA/RNA Molecule: Synthetic oligonucleotide
cuuuugaccugcuaaucaagucaca

SEQ ID NO: 106 - DNA, 25 bp, Artificial Sequence
  Description of Artificial Sequence: Synthetic oligonucleotide
  Description of Combined DNA/RNA Molecule: Synthetic oligonucleotide
guggacuuuccggaaaugauggcag

SEQ ID NO: 107 - DNA, 25 bp, Artificial Sequence
  Description of Artificial Sequence: Synthetic oligonucleotide
  Description of Combined DNA/RNA Molecule: Synthetic oligonucleotide
uggacuuuccggaaaugauggcaga

SEQ ID NO: 108 - DNA, 25 bp, Artificial Sequence
  Description of Artificial Sequence: Synthetic oligonucleotide
  Description of Combined DNA/RNA Molecule: Synthetic oligonucleotide
auggcagagaucaucucugugcaag

SEQ ID NO: 109 - DNA, 25 bp, Artificial Sequence
  Description of Artificial Sequence: Synthetic oligonucleotide
  Description of Combined DNA/RNA Molecule: Synthetic oligonucleotide
agagaucaucucugugcaagugccc

SEQ ID NO: 110 - DNA, 25 bp, Artificial Sequence
  Description of Artificial Sequence: Synthetic oligonucleotide
  Description of Combined DNA/RNA Molecule: Synthetic oligonucleotide
gagaucaucucugugcaagugccca

SEQ ID NO: 111 - DNA, 25 bp, Artificial Sequence
  Description of Artificial Sequence: Synthetic oligonucleotide
  Description of Combined DNA/RNA Molecule: Synthetic oligonucleotide
caagauccuuucugggaaagucaag

SEQ ID NO: 112 - DNA, 25 bp, Artificial Sequence
  Description of Artificial Sequence: Synthetic oligonucleotide
  Description of Combined DNA/RNA Molecule: Synthetic oligonucleotide
gaagcauuggaaacccuauuucccc

SEQ ID NO: 113 - DNA, 25 bp, Artificial Sequence
  Description of Artificial Sequence: Synthetic oligonucleotide
  Description of Combined DNA/RNA Molecule: Synthetic oligonucleotide
gaugucuucugccuguuauaacuct

SEQ ID NO: 114 - DNA, 25 bp, Artificial Sequence
  Description of Artificial Sequence: Synthetic oligonucleotide
  Description of Combined DNA/RNA Molecule: Synthetic oligonucleotide
cuuggggaauuuccucuauugaugt

SEQ ID NO: 115 - DNA, 25 bp, Artificial Sequence
  Description of Artificial Sequence: Synthetic oligonucleotide
  Description of Combined DNA/RNA Molecule: Synthetic oligonucleotide
uggggaauuuccucuauugauguac

SEQ ID NO: 116 - DNA, 25 bp, Artificial Sequence
  Description of Artificial Sequence: Synthetic oligonucleotide
  Description of Combined DNA/RNA Molecule: Synthetic oligonucleotide
ggggaauuuccucuauugauguaca

SEQ ID NO: 117 - DNA, 25 bp, Artificial Sequence
  Description of Artificial Sequence: Synthetic oligonucleotide
  Description of Combined DNA/RNA Molecule: Synthetic oligonucleotide
gggaauuuccucuauugauguacag

SEQ ID NO: 118 - DNA, 25 bp, Artificial Sequence
  Description of Artificial Sequence: Synthetic oligonucleotide
  Description of Combined DNA/RNA Molecule: Synthetic oligonucleotide
ggaauuuccucuauugauguacagt

SEQ ID NO: 119 - DNA, 25 bp, Artificial Sequence
  Description of Artificial Sequence: Synthetic oligonucleotide
  Description of Combined DNA/RNA Molecule: Synthetic oligonucleotide
auugauguacagucugucaugaaca

SEQ ID NO: 120 - DNA, 25 bp, Artificial Sequence
  Description of Artificial Sequence: Synthetic oligonucleotide
  Description of Combined DNA/RNA Molecule: Synthetic oligonucleotide
uugauguacagucugucaugaacat

SEQ ID NO: 121 - DNA, 25 bp, Artificial Sequence
  Description of Artificial Sequence: Synthetic oligonucleotide
  Description of Combined DNA/RNA Molecule: Synthetic oligonucleotide
ugauguacagucugucaugaacatg

SEQ ID NO: 122 - DNA, 25 bp, Artificial Sequence
  Description of Artificial Sequence: Synthetic oligonucleotide
  Description of Combined DNA/RNA Molecule: Synthetic oligonucleotide
cauguuccugaauucuauuugcugg

SEQ ID NO: 123 - DNA, 25 bp, Artificial Sequence
  Description of Artificial Sequence: Synthetic oligonucleotide
  Description of Combined DNA/RNA Molecule: Synthetic oligonucleotide
cuauuugcugggcuuuuuuuuuctc

SEQ ID NO: 124 - DNA, 25 bp, Artificial Sequence
  Description of Artificial Sequence: Synthetic oligonucleotide
  Description of Combined DNA/RNA Molecule: Synthetic oligonucleotide
uauuugcugggcuuuuuuuuucuct

SEQ ID NO: 125 - DNA, 25 bp, Artificial Sequence
  Description of Artificial Sequence: Synthetic oligonucleotide
  Description of Combined DNA/RNA Molecule: Synthetic oligonucleotide
cugggcuuuuuuuuucucuuucuct

SEQ ID NO: 126 - DNA, 25 bp, Artificial Sequence
  Description of Artificial Sequence: Synthetic oligonucleotide
  Description of Combined DNA/RNA Molecule: Synthetic oligonucleotide
uuuuuucucuuucucuccuuucutt

SEQ ID NO: 127 - DNA, 25 bp, Artificial Sequence
  Description of Artificial Sequence: Synthetic oligonucleotide
  Description of Combined DNA/RNA Molecule: Synthetic oligonucleotide
cagacuuugcuucccauuguggctc

SEQ ID NO: 128 - DNA, 25 bp, Artificial Sequence
  Description of Artificial Sequence: Synthetic oligonucleotide
  Description of Combined DNA/RNA Molecule: Synthetic oligonucleotide
guggcuccuaucuguguuuugaatg

SEQ ID NO: 129 - DNA, 25 bp, Artificial Sequence
  Description of Artificial Sequence: Synthetic oligonucleotide
  Description of Combined DNA/RNA Molecule: Synthetic oligonucleotide
cuaucuguguuuugaaugguguugt

SEQ ID NO: 130 - DNA, 25 bp, Artificial Sequence
  Description of Artificial Sequence: Synthetic oligonucleotide
  Description of Combined DNA/RNA Molecule: Synthetic oligonucleotide
cuguguuuugaaugguguuguaugc

SEQ ID NO: 131 - DNA, 25 bp, Artificial Sequence
  Description of Artificial Sequence: Synthetic oligonucleotide
  Description of Combined DNA/RNA Molecule: Synthetic oligonucleotide
uguuuugaaugguguuguaugcctt

SEQ ID NO: 132 - DNA, 25 bp, Artificial Sequence
  Description of Artificial Sequence: Synthetic oligonucleotide
  Description of Combined DNA/RNA Molecule: Synthetic oligonucleotide
aaugguguuguaugccuuuaaauct

SEQ ID NO: 133 - DNA, 25 bp, Artificial Sequence
  Description of Artificial Sequence: Synthetic oligonucleotide
  Description of Combined DNA/RNA Molecule: Synthetic oligonucleotide
augguguuguaugccuuuaaauctg

SEQ ID NO: 134 - DNA, 25 bp, Artificial Sequence
  Description of Artificial Sequence: Synthetic oligonucleotide
  Description of Combined DNA/RNA Molecule: Synthetic oligonucleotide
uuguaugccuuuaaaucugugauga

SEQ ID NO: 135 - DNA, 25 bp, Artificial Sequence
  Description of Artificial Sequence: Synthetic oligonucleotide
  Description of Combined DNA/RNA Molecule: Synthetic oligonucleotide
guaugccuuuaaaucugugaugatc

SEQ ID NO: 136 - DNA, 25 bp, Artificial Sequence
  Description of Artificial Sequence: Synthetic oligonucleotide
  Description of Combined DNA/RNA Molecule: Synthetic oligonucleotide
uaugccuuuaaaucugugaugaucc

SEQ ID NO: 137 - DNA, 25 bp, Artificial Sequence
  Description of Artificial Sequence: Synthetic oligonucleotide
  Description of Combined DNA/RNA Molecule: Synthetic oligonucleotide
cagugucaaguugugcuuguuuaca

SEQ ID NO: 138 - DNA, 25 bp, Artificial Sequence
  Description of Artificial Sequence: Synthetic oligonucleotide
  Description of Combined DNA/RNA Molecule: Synthetic oligonucleotide
agugucaaguugugcuuguuuacag

SEQ ID NO: 139 - DNA, 25 bp, Artificial Sequence
  Description of Artificial Sequence: Synthetic oligonucleotide
  Description of Combined DNA/RNA Molecule: Synthetic oligonucleotide
uuguuuacagcacuacucugugcca

SEQ ID NO: 140 - DNA, 25 bp, Artificial Sequence
  Description of Artificial Sequence: Synthetic oligonucleotide
  Description of Combined DNA/RNA Molecule: Synthetic oligonucleotide
uguuuacagcacuacucugugccag

SEQ ID NO: 141 - DNA, 25 bp, Artificial Sequence
  Description of Artificial Sequence: Synthetic oligonucleotide
  Description of Combined DNA/RNA Molecule: Synthetic oligonucleotide
caaacguuuacuuaucuuaugccac

SEQ ID NO: 142 - DNA, 25 bp, Artificial Sequence
  Description of Artificial Sequence: Synthetic oligonucleotide
  Description of Combined DNA/RNA Molecule: Synthetic oligonucleotide
cgggaaguuuagagagcuaagauta

SEQ ID NO: 143 - DNA, 25 bp, Artificial Sequence
  Description of Artificial Sequence: Synthetic oligonucleotide
  Description of Combined DNA/RNA Molecule: Synthetic oligonucleotide
gggaaguuuagagagcuaagauuat

SEQ ID NO: 144 - DNA, 25 bp, Artificial Sequence
  Description of Artificial Sequence: Synthetic oligonucleotide
  Description of Combined DNA/RNA Molecule: Synthetic oligonucleotide
ggaaguuuagagagcuaagauuatc

SEQ ID NO: 145 - DNA, 25 bp, Artificial Sequence
  Description of Artificial Sequence: Synthetic oligonucleotide
  Description of Combined DNA/RNA Molecule: Synthetic oligonucleotide
gaaguuuagagagcuaagauuauct

SEQ ID NO: 146 - DNA, 25 bp, Artificial Sequence
  Description of Artificial Sequence: Synthetic oligonucleotide
  Description of Combined DNA/RNA Molecule: Synthetic oligonucleotide
aguuuagagagcuaagauuaucugg

SEQ ID NO: 147 - DNA, 25 bp, Artificial Sequence
  Description of Artificial Sequence: Synthetic oligonucleotide
  Description of Combined DNA/RNA Molecule: Synthetic oligonucleotide
agagagcuaagauuaucuggggaaa

SEQ ID NO: 148 - DNA, 25 bp, Artificial Sequence
  Description of Artificial Sequence: Synthetic oligonucleotide
  Description of Combined DNA/RNA Molecule: Synthetic oligonucleotide
gagagcuaagauuaucuggggaaat

SEQ ID NO: 149 - DNA, 25 bp, Artificial Sequence
  Description of Artificial Sequence: Synthetic oligonucleotide
  Description of Combined DNA/RNA Molecule: Synthetic oligonucleotide
agagcuaagauuaucuggggaaatc

SEQ ID NO: 150 - DNA, 25 bp, Artificial Sequence
  Description of Artificial Sequence: Synthetic oligonucleotide
  Description of Combined DNA/RNA Molecule: Synthetic oligonucleotide
agauuaucuggggaaaucaaaacaa

SEQ ID NO: 151 - DNA, 25 bp, Artificial Sequence
  Description of Artificial Sequence: Synthetic oligonucleotide
  Description of Combined DNA/RNA Molecule: Synthetic oligonucleotide
gauuaucuggggaaaucaaaacaaa

SEQ ID NO: 152 - DNA, 25 bp, Artificial Sequence
  Description of Artificial Sequence: Synthetic oligonucleotide
  Description of Combined DNA/RNA Molecule: Synthetic oligonucleotide
cuggggaaaucaaaacaaaaacaag

SEQ ID NO: 153 - DNA, 25 bp, Artificial Sequence
  Description of Artificial Sequence: Synthetic oligonucleotide
  Description of Combined DNA/RNA Molecule: Synthetic oligonucleotide
ggaaaucaaaacaaaaacaagcaaa

SEQ ID NO: 154 - RNA, 27 nt, Artificial Sequence
  Description of Artificial Sequence: Synthetic oligonucleotide
agucuuuagcagcuuuuaaaaacuuca

SEQ ID NO: 155 - RNA, 27 nt, Artificial Sequence
  Description of Artificial Sequence: Synthetic oligonucleotide
gagucuuuagcagcuuuuaaaaacuuc

SEQ ID NO: 156 - RNA, 27 nt, Artificial Sequence
  Description of Artificial Sequence: Synthetic oligonucleotide
cgagucuuuagcagcuuuuaaaaacuu

SEQ ID NO: 157 - RNA, 27 nt, Artificial Sequence
  Description of Artificial Sequence: Synthetic oligonucleotide
uuucaucuuuugaucucuggcuccgca

SEQ ID NO: 158 - RNA, 27 nt, Artificial Sequence
  Description of Artificial Sequence: Synthetic oligonucleotide
cugccuuuucaucuuuugaucucuggc

SEQ ID NO: 159 - RNA, 27 nt, Artificial Sequence
  Description of Artificial Sequence: Synthetic oligonucleotide
acugccuuuucaucuuuugaucucugg

SEQ ID NO: 160 - RNA, 27 nt, Artificial Sequence
  Description of Artificial Sequence: Synthetic oligonucleotide
aagaccugacugccuuuucaucuuuug

SEQ ID NO: 161 - RNA, 27 nt, Artificial Sequence
  Description of Artificial Sequence: Synthetic oligonucleotide
gaagaccugacugccuuuucaucuuuu

SEQ ID NO: 162 - RNA, 27 nt, Artificial Sequence
  Description of Artificial Sequence: Synthetic oligonucleotide
uuguuuuuuggcuacugaagaccugac

SEQ ID NO: 163 - RNA, 27 nt, Artificial Sequence
  Description of Artificial Sequence: Synthetic oligonucleotide
uuuguuuuuuggcuacugaagaccuga

SEQ ID NO: 164 - RNA, 27 nt, Artificial Sequence
  Description of Artificial Sequence: Synthetic oligonucleotide
uuuguuuguuuuguuuuuuggcuacug

SEQ ID NO: 165 - RNA, 27 nt, Artificial Sequence
  Description of Artificial Sequence: Synthetic oligonucleotide
uuguuuuuguuuguuuuguuuuuuggc

SEQ ID NO: 166 - RNA, 27 nt, Artificial Sequence
  Description of Artificial Sequence: Synthetic oligonucleotide
uuuguuuuuguuuguuuuguuuuuugg

SEQ ID NO: 167 - RNA, 27 nt, Artificial Sequence
  Description of Artificial Sequence: Synthetic oligonucleotide
cggcuuuuuuguuuuuguuuguuuugu

SEQ ID NO: 168 - RNA, 27 nt, Artificial Sequence
  Description of Artificial Sequence: Synthetic oligonucleotide
uuuuauuucggcuuuuuuguuuuuguu

SEQ ID NO: 169 - RNA, 27 nt, Artificial Sequence
  Description of Artificial Sequence: Synthetic oligonucleotide
cuuuuauuucggcuuuuuuguuuuugu

SEQ ID NO: 170 - RNA, 27 nt, Artificial Sequence
  Description of Artificial Sequence: Synthetic oligonucleotide
ucuuuuauuucggcuuuuuuguuuuug

SEQ ID NO: 171 - RNA, 27 nt, Artificial Sequence
  Description of Artificial Sequence: Synthetic oligonucleotide
cuuuuucuuuuauuucggcuuuuuugu

SEQ ID NO: 172 - RNA, 27 nt, Artificial Sequence
  Description of Artificial Sequence: Synthetic oligonucleotide
ucuuuuucuuuuauuucggcuuuuuug

SEQ ID NO: 173 - RNA, 27 nt, Artificial Sequence
  Description of Artificial Sequence: Synthetic oligonucleotide
uaucuuuuucuuuuauuucggcuuuuu

SEQ ID NO: 174 - RNA, 27 nt, Artificial Sequence
  Description of Artificial Sequence: Synthetic oligonucleotide
guuauuaucuuuuucuuuuauuucggc

SEQ ID NO: 175 - RNA, 27 nt, Artificial Sequence
  Description of Artificial Sequence: Synthetic oligonucleotide
aguuauuaucuuuuucuuuuauuucgg

SEQ ID NO: 176 - RNA, 27 nt, Artificial Sequence
  Description of Artificial Sequence: Synthetic oligonucleotide
gaguuauuaucuuuuucuuuuauuucg

SEQ ID NO: 177 - RNA, 27 nt, Artificial Sequence
  Description of Artificial Sequence: Synthetic oligonucleotide
uaagaacugaguuauuaucuuuuucuu

SEQ ID NO: 178 - RNA, 27 nt, Artificial Sequence
  Description of Artificial Sequence: Synthetic oligonucleotide
caaauaagaacugaguuauuaucuuuu

SEQ ID NO: 179 - RNA, 27 nt, Artificial Sequence
  Description of Artificial Sequence: Synthetic oligonucleotide
gcaaauaagaacugaguuauuaucuuu

SEQ ID NO: 180 - RNA, 27 nt, Artificial Sequence
  Description of Artificial Sequence: Synthetic oligonucleotide
gugcaaauaagaacugaguuauuaucu

SEQ ID NO: 181 - RNA, 27 nt, Artificial Sequence
  Description of Artificial Sequence: Synthetic oligonucleotide
ggugcaaauaagaacugaguuauuauc

SEQ ID NO: 182 - RNA, 27 nt, Artificial Sequence
  Description of Artificial Sequence: Synthetic oligonucleotide
uguccacugaaguaggugcaaauaaga

SEQ ID NO: 183 - RNA, 27 nt, Artificial Sequence
  Description of Artificial Sequence: Synthetic oligonucleotide
ccaccuuccaaauucaguguccacuga

SEQ ID NO: 184 - RNA, 27 nt, Artificial Sequence
  Description of Artificial Sequence: Synthetic oligonucleotide
aaaauccuccaccuuccaaauucagug

SEQ ID NO: 185 - RNA, 27 nt, Artificial Sequence
  Description of Artificial Sequence: Synthetic oligonucleotide
aaaaaacaaaauccuccaccuuccaaa

SEQ ID NO: 186 - RNA, 27 nt, Artificial Sequence
  Description of Artificial Sequence: Synthetic oligonucleotide
agaaaaaaacaaaauccuccaccuucc

SEQ ID NO: 187 - RNA, 27 nt, Artificial Sequence
  Description of Artificial Sequence: Synthetic oligonucleotide
cuuaaaagaaaaaaacaaaauccucca

SEQ ID NO: 188 - RNA, 27 nt, Artificial Sequence
  Description of Artificial Sequence: Synthetic oligonucleotide
ucuuaaaagaaaaaaacaaaauccucc

SEQ ID NO: 189 - RNA, 27 nt, Artificial Sequence
  Description of Artificial Sequence: Synthetic oligonucleotide
gaucuuaaaagaaaaaaacaaaauccu

SEQ ID NO: 190 - RNA, 27 nt, Artificial Sequence
  Description of Artificial Sequence: Synthetic oligonucleotide
agaucuuaaaagaaaaaaacaaaaucc

SEQ ID NO: 191 - RNA, 27 nt, Artificial Sequence
  Description of Artificial Sequence: Synthetic oligonucleotide
cagaucuuaaaagaaaaaaacaaaauc

SEQ ID NO: 192 - RNA, 27 nt, Artificial Sequence
  Description of Artificial Sequence: Synthetic oligonucleotide
ccagaucuuaaaagaaaaaaacaaaau

SEQ ID NO: 193 - RNA, 27 nt, Artificial Sequence
  Description of Artificial Sequence: Synthetic oligonucleotide
augcccagaucuuaaaagaaaaaaaca

SEQ ID NO: 194 - RNA, 27 nt, Artificial Sequence
  Description of Artificial Sequence: Synthetic oligonucleotide
gaugcccagaucuuaaaagaaaaaaac

SEQ ID NO: 195 - RNA, 27 nt, Artificial Sequence
  Description of Artificial Sequence: Synthetic oligonucleotide
agauucaaaagaugcccagaucuuaaa

SEQ ID NO: 196 - RNA, 27 nt, Artificial Sequence
  Description of Artificial Sequence: Synthetic oligonucleotide
aauacuugaaggguagauucaaaagau

SEQ ID NO: 197 - RNA, 27 nt, Artificial Sequence
  Description of Artificial Sequence: Synthetic oligonucleotide
uaauacuugaaggguagauucaaaaga

SEQ ID NO: 198 - RNA, 27 nt, Artificial Sequence
  Description of Artificial Sequence: Synthetic oligonucleotide
uuaauacuugaaggguagauucaaaag

SEQ ID NO: 199 - RNA, 27 nt, Artificial Sequence
  Description of Artificial Sequence: Synthetic oligonucleotide
cuuaauacuugaaggguagauucaaaa

SEQ ID NO: 200 - RNA, 27 nt, Artificial Sequence
  Description of Artificial Sequence: Synthetic oligonucleotide
ucuuaauacuugaaggguagauucaaa

SEQ ID NO: 201 - RNA, 27 nt, Artificial Sequence
  Description of Artificial Sequence: Synthetic oligonucleotide
gcucacagucugucucuuaauacuuga

SEQ ID NO: 202 - RNA, 27 nt, Artificial Sequence
  Description of Artificial Sequence: Synthetic oligonucleotide
uaggcucacagucugucucuuaauacu

SEQ ID NO: 203 - RNA, 27 nt, Artificial Sequence
  Description of Artificial Sequence: Synthetic oligonucleotide
cuucucuugcucagaagaguucaacag

SEQ ID NO: 204 - RNA, 27 nt, Artificial Sequence
  Description of Artificial Sequence: Synthetic oligonucleotide
ccuucucuugcucagaagaguucaaca

SEQ ID NO: 205 - RNA, 27 nt, Artificial Sequence
  Description of Artificial Sequence: Synthetic oligonucleotide
ccagcccuaacugcacuuccauccuug

SEQ ID NO: 206 - RNA, 27 nt, Artificial Sequence
  Description of Artificial Sequence: Synthetic oligonucleotide
uggaacagauucuggaaagcuccucgg

SEQ ID NO: 207 - RNA, 27 nt, Artificial Sequence
  Description of Artificial Sequence: Synthetic oligonucleotide
cuggaacagauucuggaaagcuccucg

SEQ ID NO: 208 - RNA, 27 nt, Artificial Sequence
  Description of Artificial Sequence: Synthetic oligonucleotide
ucgcucaggaugucuuuaaggucagcg

SEQ ID NO: 209 - RNA, 27 nt, Artificial Sequence
  Description of Artificial Sequence: Synthetic oligonucleotide
agugcccccuaaguaauuguccuugga

SEQ ID NO: 210 - RNA, 27 nt, Artificial Sequence
  Description of Artificial Sequence: Synthetic oligonucleotide
ccgacacugccuuacacaacuccuugg

SEQ ID NO: 211 - RNA, 27 nt, Artificial Sequence
  Description of Artificial Sequence: Synthetic oligonucleotide
ggggaauacucagcaguaucuucagug

SEQ ID NO: 212 - RNA, 27 nt, Artificial Sequence
  Description of Artificial Sequence: Synthetic oligonucleotide
ccucccuugaaaggggaauacucagca

SEQ ID NO: 213 - RNA, 27 nt, Artificial Sequence
  Description of Artificial Sequence: Synthetic oligonucleotide
gggcccauuucgcuuuugacacaagug

SEQ ID NO: 214 - RNA, 27 nt, Artificial Sequence
  Description of Artificial Sequence: Synthetic oligonucleotide
ggggcccauuucgcuuuugacacaagu

SEQ ID NO: 215 - RNA, 27 nt, Artificial Sequence
  Description of Artificial Sequence: Synthetic oligonucleotide
aguaauagucaaugggcaaaacauggu

SEQ ID NO: 216 - RNA, 27 nt, Artificial Sequence
  Description of Artificial Sequence: Synthetic oligonucleotide
aaaguaauagucaaugggcaaaacaug

SEQ ID NO: 217 - RNA, 27 nt, Artificial Sequence
  Description of Artificial Sequence: Synthetic oligonucleotide
ugacacccagaagcuucaucuccacag

SEQ ID NO: 218 - RNA, 27 nt, Artificial Sequence
  Description of Artificial Sequence: Synthetic oligonucleotide
gcgcacagguacuucuguuucccuuca

SEQ ID NO: 219 - RNA, 27 nt, Artificial Sequence
  Description of Artificial Sequence: Synthetic oligonucleotide
auuuaucaauagugcaaucauuucugc

SEQ ID NO: 220 - RNA, 27 nt, Artificial Sequence
  Description of Artificial Sequence: Synthetic oligonucleotide
aauuuaucaauagugcaaucauuucug

SEQ ID NO: 221 - RNA, 27 nt, Artificial Sequence
  Description of Artificial Sequence: Synthetic oligonucleotide
gaauuuaucaauagugcaaucauuucu

SEQ ID NO: 222 - RNA, 27 nt, Artificial Sequence
  Description of Artificial Sequence: Synthetic oligonucleotide
cggaauuuaucaauagugcaaucauuu

SEQ ID NO: 223 - RNA, 27 nt, Artificial Sequence
  Description of Artificial Sequence: Synthetic oligonucleotide
ucggaauuuaucaauagugcaaucauu

SEQ ID NO: 224 - RNA, 27 nt, Artificial Sequence
  Description of Artificial Sequence: Synthetic oligonucleotide
uuuuuccuucggaauuuaucaauagug

SEQ ID NO: 225 - RNA, 27 nt, Artificial Sequence
  Description of Artificial Sequence: Synthetic oligonucleotide
auuuuuccuucggaauuuaucaauagu

SEQ ID NO: 226 - RNA, 27 nt, Artificial Sequence
  Description of Artificial Sequence: Synthetic oligonucleotide
aauuuuuccuucggaauuuaucaauag

SEQ ID NO: 227 - RNA, 27 nt, Artificial Sequence
  Description of Artificial Sequence: Synthetic oligonucleotide
caauuuuuccuucggaauuuaucaaua

SEQ ID NO: 228 - RNA, 27 nt, Artificial Sequence
  Description of Artificial Sequence: Synthetic oligonucleotide
acaauuuuuccuucggaauuuaucaau

SEQ ID NO: 229 - RNA, 27 nt, Artificial Sequence
  Description of Artificial Sequence: Synthetic oligonucleotide
ggacaauuuuuccuucggaauuuauca

SEQ ID NO: 230 - RNA, 27 nt, Artificial Sequence
  Description of Artificial Sequence: Synthetic oligonucleotide
uggacaauuuuuccuucggaauuuauc

SEQ ID NO: 231 - RNA, 27 nt, Artificial Sequence
  Description of Artificial Sequence: Synthetic oligonucleotide
acgacaagauggacaauuuuuccuucg

SEQ ID NO: 232 - RNA, 27 nt, Artificial Sequence
  Description of Artificial Sequence: Synthetic oligonucleotide
ucauaacauuuccgaagacgacaagau

SEQ ID NO: 233 - RNA, 27 nt, Artificial Sequence
  Description of Artificial Sequence: Synthetic oligonucleotide
agucaucccugcuucauaacauuuccg

SEQ ID NO: 234 - RNA, 27 nt, Artificial Sequence
  Description of Artificial Sequence: Synthetic oligonucleotide
agagucaucccugcuucauaacauuuc

SEQ ID NO: 235 - RNA, 27 nt, Artificial Sequence
  Description of Artificial Sequence: Synthetic oligonucleotide
gauuaccaaguuucuucagcuuccggg

SEQ ID NO: 236 - RNA, 27 nt, Artificial Sequence
  Description of Artificial Sequence: Synthetic oligonucleotide
cagauuaccaaguuucuucagcuuccg

SEQ ID NO: 237 - RNA, 27 nt, Artificial Sequence
  Description of Artificial Sequence: Synthetic oligonucleotide
aguuucagauuaccaaguuucuucagc

SEQ ID NO: 238 - RNA, 27 nt, Artificial Sequence
  Description of Artificial Sequence: Synthetic oligonucleotide
uaguuucagauuaccaaguuucuucag

SEQ ID NO: 239 - RNA, 27 nt, Artificial Sequence
  Description of Artificial Sequence: Synthetic oligonucleotide
guaguuucagauuaccaaguuucuuca

SEQ ID NO: 240 - RNA, 27 nt, Artificial Sequence
  Description of Artificial Sequence: Synthetic oligonucleotide
cuuccuccuguaguuucagauuaccaa

SEQ ID NO: 241 - RNA, 27 nt, Artificial Sequence
  Description of Artificial Sequence: Synthetic oligonucleotide
ccucuccuuccuccuguaguuucagau

SEQ ID NO: 242 - RNA, 27 nt, Artificial Sequence
  Description of Artificial Sequence: Synthetic oligonucleotide
gugcuuucaugcacaggaauuccuggg

SEQ ID NO: 243 - RNA, 27 nt, Artificial Sequence
  Description of Artificial Sequence: Synthetic oligonucleotide
agugcuuucaugcacaggaauuccugg

SEQ ID NO: 244 - RNA, 27 nt, Artificial Sequence
  Description of Artificial Sequence: Synthetic oligonucleotide
gaauuuuugauuuuucagcccauccac

SEQ ID NO: 245 - RNA, 27 nt, Artificial Sequence
  Description of Artificial Sequence: Synthetic oligonucleotide
agaauuuuugauuuuucagcccaucca

SEQ ID NO: 246 - RNA, 27 nt, Artificial Sequence
  Description of Artificial Sequence: Synthetic oligonucleotide
aaagaauuuuugauuuuucagcccauc

SEQ ID NO: 247 - RNA, 27 nt, Artificial Sequence
  Description of Artificial Sequence: Synthetic oligonucleotide
caucaaagaauuuuugauuuuucagcc

SEQ ID NO: 248 - RNA, 27 nt, Artificial Sequence
  Description of Artificial Sequence: Synthetic oligonucleotide
ucaucaaagaauuuuugauuuuucagc

SEQ ID NO: 249 - RNA, 27 nt, Artificial Sequence
  Description of Artificial Sequence: Synthetic oligonucleotide
guucaucaaagaauuuuugauuuuuca

SEQ ID NO: 250 - RNA, 27 nt, Artificial Sequence
  Description of Artificial Sequence: Synthetic oligonucleotide
aguucaucaaagaauuuuugauuuuuc

SEQ ID NO: 251 - RNA, 27 nt, Artificial Sequence
  Description of Artificial Sequence: Synthetic oligonucleotide
aaguucaucaaagaauuuuugauuuuu

SEQ ID NO: 252 - RNA, 27 nt, Artificial Sequence
  Description of Artificial Sequence: Synthetic oligonucleotide
cgaguuccuugauguaguucauucgaa

SEQ ID NO: 253 - RNA, 27 nt, Artificial Sequence
  Description of Artificial Sequence: Synthetic oligonucleotide
augcaaugauacgaucgaguuccuuga

SEQ ID NO: 254 - RNA, 27 nt, Artificial Sequence
  Description of Artificial Sequence: Synthetic oligonucleotide
caugcaaugauacgaucgaguuccuug

SEQ ID NO: 255 - RNA, 27 nt, Artificial Sequence
  Description of Artificial Sequence: Synthetic oligonucleotide
uuuuucuuuugcaugcaaugauacgau

SEQ ID NO: 256 - RNA, 27 nt, Artificial Sequence
  Description of Artificial Sequence: Synthetic oligonucleotide
uuuuuucuuuugcaugcaaugauacga

SEQ ID NO: 257 - RNA, 27 nt, Artificial Sequence
  Description of Artificial Sequence: Synthetic oligonucleotide
gggauuuuuucuuuugcaugcaaugau

SEQ ID NO: 258 - RNA, 27 nt, Artificial Sequence
  Description of Artificial Sequence: Synthetic oligonucleotide
ugugacuugauuagcaggucaaaagug

SEQ ID NO: 259 - RNA, 27 nt, Artificial Sequence
  Description of Artificial Sequence: Synthetic oligonucleotide
cugccaucauuuccggaaaguccacgc

SEQ ID NO: 260 - RNA, 27 nt, Artificial Sequence
  Description of Artificial Sequence: Synthetic oligonucleotide
ucugccaucauuuccggaaaguccacg

SEQ ID NO: 261 - RNA, 27 nt, Artificial Sequence
  Description of Artificial Sequence: Synthetic oligonucleotide
cuugcacagagaugaucucugccauca

SEQ ID NO: 262 - RNA, 27 nt, Artificial Sequence
  Description of Artificial Sequence: Synthetic oligonucleotide
gggcacuugcacagagaugaucucugc

SEQ ID NO: 263 - RNA, 27 nt, Artificial Sequence
  Description of Artificial Sequence: Synthetic oligonucleotide
ugggcacuugcacagagaugaucucug

SEQ ID NO: 264 - RNA, 27 nt, Artificial Sequence
  Description of Artificial Sequence: Synthetic oligonucleotide
cuugacuuucccagaaaggaucuuggg

SEQ ID NO: 265 - RNA, 27 nt, Artificial Sequence
  Description of Artificial Sequence: Synthetic oligonucleotide
ggggaaauaggguuuccaaugcuucac

SEQ ID NO: 266 - RNA, 27 nt, Artificial Sequence
  Description of Artificial Sequence: Synthetic oligonucleotide
agaguuauaacaggcagaagacaucug

SEQ ID NO: 267 - RNA, 27 nt, Artificial Sequence
  Description of Artificial Sequence: Synthetic oligonucleotide
acaucaauagaggaaauuccccaaggc

SEQ ID NO: 268 - RNA, 27 nt, Artificial Sequence
  Description of Artificial Sequence: Synthetic oligonucleotide
guacaucaauagaggaaauuccccaag

SEQ ID NO: 269 - RNA, 27 nt, Artificial Sequence
  Description of Artificial Sequence: Synthetic oligonucleotide
uguacaucaauagaggaaauuccccaa

SEQ ID NO: 270 - RNA, 27 nt, Artificial Sequence
  Description of Artificial Sequence: Synthetic oligonucleotide
cuguacaucaauagaggaaauucccca

SEQ ID NO: 271 - RNA, 27 nt, Artificial Sequence
  Description of Artificial Sequence: Synthetic oligonucleotide
acuguacaucaauagaggaaauucccc

SEQ ID NO: 272 - RNA, 27 nt, Artificial Sequence
  Description of Artificial Sequence: Synthetic oligonucleotide
uguucaugacagacuguacaucaauag

SEQ ID NO: 273 - RNA, 27 nt, Artificial Sequence
  Description of Artificial Sequence: Synthetic oligonucleotide
auguucaugacagacuguacaucaaua

SEQ ID NO: 274 - RNA, 27 nt, Artificial Sequence
  Description of Artificial Sequence: Synthetic oligonucleotide
cauguucaugacagacuguacaucaau

SEQ ID NO: 275 - RNA, 27 nt, Artificial Sequence
  Description of Artificial Sequence: Synthetic oligonucleotide
ccagcaaauagaauucaggaacauguu

SEQ ID NO: 276 - RNA, 27 nt, Artificial Sequence
  Description of Artificial Sequence: Synthetic oligonucleotide
gagaaaaaaaaagcccagcaaauagaa

SEQ ID NO: 277 - RNA, 27 nt, Artificial Sequence
  Description of Artificial Sequence: Synthetic oligonucleotide
agagaaaaaaaaagcccagcaaauaga

SEQ ID NO: 278 - RNA, 27 nt, Artificial Sequence
  Description of Artificial Sequence: Synthetic oligonucleotide
agagaaagagaaaaaaaaagcccagca

SEQ ID NO: 279 - RNA, 27 nt, Artificial Sequence
  Description of Artificial Sequence: Synthetic oligonucleotide
aaagaaaggagagaaagagaaaaaaaa

SEQ ID NO: 280 - RNA, 27 nt, Artificial Sequence
  Description of Artificial Sequence: Synthetic oligonucleotide
gagccacaaugggaagcaaagucugaa

SEQ ID NO: 281 - RNA, 27 nt, Artificial Sequence
  Description of Artificial Sequence: Synthetic oligonucleotide
cauucaaaacacagauaggagccacaa

SEQ ID NO: 282 - RNA, 27 nt, Artificial Sequence
  Description of Artificial Sequence: Synthetic oligonucleotide
acaacaccauucaaaacacagauagga

SEQ ID NO: 283 - RNA, 27 nt, Artificial Sequence
  Description of Artificial Sequence: Synthetic oligonucleotide
gcauacaacaccauucaaaacacagau

SEQ ID NO: 284 - RNA, 27 nt, Artificial Sequence
  Description of Artificial Sequence: Synthetic oligonucleotide
aaggcauacaacaccauucaaaacaca

SEQ ID NO: 285 - RNA, 27 nt, Artificial Sequence
  Description of Artificial Sequence: Synthetic oligonucleotide
agauuuaaaggcauacaacaccauuca

SEQ ID NO: 286 - RNA, 27 nt, Artificial Sequence
  Description of Artificial Sequence: Synthetic oligonucleotide
cagauuuaaaggcauacaacaccauuc

SEQ ID NO: 287 - RNA, 27 nt, Artificial Sequence
  Description of Artificial Sequence: Synthetic oligonucleotide
ucaucacagauuuaaaggcauacaaca

SEQ ID NO: 288 - RNA, 27 nt, Artificial Sequence
  Description of Artificial Sequence: Synthetic oligonucleotide
gaucaucacagauuuaaaggcauacaa

SEQ ID NO: 289 - RNA, 27 nt, Artificial Sequence
  Description of Artificial Sequence: Synthetic oligonucleotide
ggaucaucacagauuuaaaggcauaca

SEQ ID NO: 290 - RNA, 27 nt, Artificial Sequence
  Description of Artificial Sequence: Synthetic oligonucleotide
uguaaacaagcacaacuugacacuggg

SEQ ID NO: 291 - RNA, 27 nt, Artificial Sequence
  Description of Artificial Sequence: Synthetic oligonucleotide
cuguaaacaagcacaacuugacacugg

SEQ ID NO: 292 - RNA, 27 nt, Artificial Sequence
  Description of Artificial Sequence: Synthetic oligonucleotide
uggcacagaguagugcuguaaacaagc

SEQ ID NO: 293 - RNA, 27 nt, Artificial Sequence
  Description of Artificial Sequence: Synthetic oligonucleotide
cuggcacagaguagugcuguaaacaag

SEQ ID NO: 294 - RNA, 27 nt, Artificial Sequence
  Description of Artificial Sequence: Synthetic oligonucleotide
guggcauaagauaaguaaacguuugug

SEQ ID NO: 295 - RNA, 27 nt, Artificial Sequence
  Description of Artificial Sequence: Synthetic oligonucleotide
uaaucuuagcucucuaaacuucccgug

SEQ ID NO: 296 - RNA, 27 nt, Artificial Sequence
  Description of Artificial Sequence: Synthetic oligonucleotide
auaaucuuagcucucuaaacuucccgu

SEQ ID NO: 297 - RNA, 27 nt, Artificial Sequence
  Description of Artificial Sequence: Synthetic oligonucleotide
gauaaucuuagcucucuaaacuucccg

SEQ ID NO: 298 - RNA, 27 nt, Artificial Sequence
  Description of Artificial Sequence: Synthetic oligonucleotide
agauaaucuuagcucucuaaacuuccc

SEQ ID NO: 299 - RNA, 27 nt, Artificial Sequence
  Description of Artificial Sequence: Synthetic oligonucleotide
ccagauaaucuuagcucucuaaacuuc

SEQ ID NO: 300 - RNA, 27 nt, Artificial Sequence
  Description of Artificial Sequence: Synthetic oligonucleotide
uuuccccagauaaucuuagcucucuaa

SEQ ID NO: 301 - RNA, 27 nt, Artificial Sequence
  Description of Artificial Sequence: Synthetic oligonucleotide
auuuccccagauaaucuuagcucucua

SEQ ID NO: 302 - RNA, 27 nt, Artificial Sequence
  Description of Artificial Sequence: Synthetic oligonucleotide
gauuuccccagauaaucuuagcucucu

SEQ ID NO: 303 - RNA, 27 nt, Artificial Sequence
  Description of Artificial Sequence: Synthetic oligonucleotide
uuguuuugauuuccccagauaaucuua

SEQ ID NO: 304 - RNA, 27 nt, Artificial Sequence
  Description of Artificial Sequence: Synthetic oligonucleotide
uuuguuuugauuuccccagauaaucuu

SEQ ID NO: 305 - RNA, 27 nt, Artificial Sequence
  Description of Artificial Sequence: Synthetic oligonucleotide
cuuguuuuuguuuugauuuccccagau

SEQ ID NO: 306 - RNA, 27 nt, Artificial Sequence
  Description of Artificial Sequence: Synthetic oligonucleotide
uuugcuuguuuuuguuuugauuucccc

SEQ ID NO: 307 - DNA, 27 bp, Artificial Sequence
  Description of Artificial Sequence: Synthetic oligonucleotide
tgaagtttttaaaagctgctaaagact

SEQ ID NO: 308 - DNA, 27 bp, Artificial Sequence
  Description of Artificial Sequence: Synthetic oligonucleotide
gaagtttttaaaagctgctaaagactc

SEQ ID NO: 309 - DNA, 27 bp, Artificial Sequence
  Description of Artificial Sequence: Synthetic oligonucleotide
aagtttttaaaagctgctaaagactcg

SEQ ID NO: 310 - DNA, 27 bp, Artificial Sequence
  Description of Artificial Sequence: Synthetic oligonucleotide
tgcggagccagagatcaaaagatgaaa

SEQ ID NO: 311 - DNA, 27 bp, Artificial Sequence
  Description of Artificial Sequence: Synthetic oligonucleotide
gccagagatcaaaagatgaaaaggcag

SEQ ID NO: 312 - DNA, 27 bp, Artificial Sequence
  Description of Artificial Sequence: Synthetic oligonucleotide
ccagagatcaaaagatgaaaaggcagt

SEQ ID NO: 313 - DNA, 27 bp, Artificial Sequence
  Description of Artificial Sequence: Synthetic oligonucleotide
caaaagatgaaaaggcagtcaggtctt

SEQ ID NO: 314 - DNA, 27 bp, Artificial Sequence
  Description of Artificial Sequence: Synthetic oligonucleotide
aaaagatgaaaaggcagtcaggtcttc

SEQ ID NO: 315 - DNA, 27 bp, Artificial Sequence
  Description of Artificial Sequence: Synthetic oligonucleotide
gtcaggtcttcagtagccaaaaaacaa

SEQ ID NO: 316 - DNA, 27 bp, Artificial Sequence
  Description of Artificial Sequence: Synthetic oligonucleotide
tcaggtcttcagtagccaaaaaacaaa

SEQ ID NO: 317 - DNA, 27 bp, Artificial Sequence
  Description of Artificial Sequence: Synthetic oligonucleotide
cagtagccaaaaaacaaaacaaacaaa

SEQ ID NO: 318 - DNA, 27 bp, Artificial Sequence
  Description of Artificial Sequence: Synthetic oligonucleotide
gccaaaaaacaaaacaaacaaaaacaa

SEQ ID NO: 319 - DNA, 27 bp, Artificial Sequence
  Description of Artificial Sequence: Synthetic oligonucleotide
ccaaaaaacaaaacaaacaaaaacaaa

SEQ ID NO: 320 - DNA, 27 bp, Artificial Sequence
  Description of Artificial Sequence: Synthetic oligonucleotide
acaaaacaaacaaaaacaaaaaagccg

SEQ ID NO: 321 - DNA, 27 bp, Artificial Sequence
  Description of Artificial Sequence: Synthetic oligonucleotide
aacaaaaacaaaaaagccgaaataaaa

SEQ ID NO: 322 - DNA, 27 bp, Artificial Sequence
  Description of Artificial Sequence: Synthetic oligonucleotide
acaaaaacaaaaaagccgaaataaaag

SEQ ID NO: 323 - DNA, 27 bp, Artificial Sequence
  Description of Artificial Sequence: Synthetic oligonucleotide
caaaaacaaaaaagccgaaataaaaga

SEQ ID NO: 324 - DNA, 27 bp, Artificial Sequence
  Description of Artificial Sequence: Synthetic oligonucleotide
acaaaaaagccgaaataaaagaaaaag

SEQ ID NO: 325 - DNA, 27 bp, Artificial Sequence
  Description of Artificial Sequence: Synthetic oligonucleotide
caaaaaagccgaaataaaagaaaaaga

SEQ ID NO: 326 - DNA, 27 bp, Artificial Sequence
  Description of Artificial Sequence: Synthetic oligonucleotide
aaaaagccgaaataaaagaaaaagata

SEQ ID NO: 327 - DNA, 27 bp, Artificial Sequence
  Description of Artificial Sequence: Synthetic oligonucleotide
gccgaaataaaagaaaaagataataac

SEQ ID NO: 328 - DNA, 27 bp, Artificial Sequence
  Description of Artificial Sequence: Synthetic oligonucleotide
ccgaaataaaagaaaaagataataact

SEQ ID NO: 329 - DNA, 27 bp, Artificial Sequence
  Description of Artificial Sequence: Synthetic oligonucleotide
cgaaataaaagaaaaagataataactc

SEQ ID NO: 330 - DNA, 27 bp, Artificial Sequence
  Description of Artificial Sequence: Synthetic oligonucleotide
aagaaaaagataataactcagttctta

SEQ ID NO: 331 - DNA, 27 bp, Artificial Sequence
  Description of Artificial Sequence: Synthetic oligonucleotide
aaaagataataactcagttcttatttg

SEQ ID NO: 332 - DNA, 27 bp, Artificial Sequence
  Description of Artificial Sequence: Synthetic oligonucleotide
aaagataataactcagttcttatttgc

SEQ ID NO: 333 - DNA, 27 bp, Artificial Sequence
  Description of Artificial Sequence: Synthetic oligonucleotide
agataataactcagttcttatttgcac

SEQ ID NO: 334 - DNA, 27 bp, Artificial Sequence
  Description of Artificial Sequence: Synthetic oligonucleotide
gataataactcagttcttatttgcacc

SEQ ID NO: 335 - DNA, 27 bp, Artificial Sequence
  Description of Artificial Sequence: Synthetic oligonucleotide
tcttatttgcacctacttcagtggaca

SEQ ID NO: 336 - DNA, 27 bp, Artificial Sequence
  Description of Artificial Sequence: Synthetic oligonucleotide
tcagtggacactgaatttggaaggtgg

SEQ ID NO: 337 - DNA, 27 bp, Artificial Sequence
  Description of Artificial Sequence: Synthetic oligonucleotide
cactgaatttggaaggtggaggatttt

SEQ ID NO: 338 - DNA, 27 bp, Artificial Sequence
  Description of Artificial Sequence: Synthetic oligonucleotide
tttggaaggtggaggattttgtttttt

SEQ ID NO: 339 - DNA, 27 bp, Artificial Sequence
  Description of Artificial Sequence: Synthetic oligonucleotide
ggaaggtggaggattttgtttttttct

SEQ ID NO: 340 - DNA, 27 bp, Artificial Sequence
  Description of Artificial Sequence: Synthetic oligonucleotide
tggaggattttgtttttttcttttaag

SEQ ID NO: 341 - DNA, 27 bp, Artificial Sequence
  Description of Artificial Sequence: Synthetic oligonucleotide
ggaggattttgtttttttcttttaaga

SEQ ID NO: 342 - DNA, 27 bp, Artificial Sequence
  Description of Artificial Sequence: Synthetic oligonucleotide
aggattttgtttttttcttttaagatc

SEQ ID NO: 343 - DNA, 27 bp, Artificial Sequence
  Description of Artificial Sequence: Synthetic oligonucleotide
ggattttgtttttttcttttaagatct

SEQ ID NO: 344 - DNA, 27 bp, Artificial Sequence
  Description of Artificial Sequence: Synthetic oligonucleotide
gattttgtttttttcttttaagatctg

SEQ ID NO: 345 - DNA, 27 bp, Artificial Sequence
  Description of Artificial Sequence: Synthetic oligonucleotide
attttgtttttttcttttaagatctgg

SEQ ID NO: 346 - DNA, 27 bp, Artificial Sequence
  Description of Artificial Sequence: Synthetic oligonucleotide
tgtttttttcttttaagatctgggcat

SEQ ID NO: 347 - DNA, 27 bp, Artificial Sequence
  Description of Artificial Sequence: Synthetic oligonucleotide
gtttttttcttttaagatctgggcatc

SEQ ID NO: 348 - DNA, 27 bp, Artificial Sequence
  Description of Artificial Sequence: Synthetic oligonucleotide
tttaagatctgggcatcttttgaatct

SEQ ID NO: 349 - DNA, 27 bp, Artificial Sequence
  Description of Artificial Sequence: Synthetic oligonucleotide
atcttttgaatctacccttcaagtatt

SEQ ID NO: 350 - DNA, 27 bp, Artificial Sequence
  Description of Artificial Sequence: Synthetic oligonucleotide
tcttttgaatctacccttcaagtatta

SEQ ID NO: 351 - DNA, 27 bp, Artificial Sequence
  Description of Artificial Sequence: Synthetic oligonucleotide
cttttgaatctacccttcaagtattaa

SEQ ID NO: 352 - DNA, 27 bp, Artificial Sequence
  Description of Artificial Sequence: Synthetic oligonucleotide
ttttgaatctacccttcaagtattaag

SEQ ID NO: 353 - DNA, 27 bp, Artificial Sequence
  Description of Artificial Sequence: Synthetic oligonucleotide
tttgaatctacccttcaagtattaaga

SEQ ID NO: 354 - DNA, 27 bp, Artificial Sequence
  Description of Artificial Sequence: Synthetic oligonucleotide
tcaagtattaagagacagactgtgagc

SEQ ID NO: 355 - DNA, 27 bp, Artificial Sequence
  Description of Artificial Sequence: Synthetic oligonucleotide
agtattaagagacagactgtgagccta

SEQ ID NO: 356 - DNA, 27 bp, Artificial Sequence
  Description of Artificial Sequence: Synthetic oligonucleotide
ctgttgaactcttctgagcaagagaag

SEQ ID NO: 357 - DNA, 27 bp, Artificial Sequence
  Description of Artificial Sequence: Synthetic oligonucleotide
tgttgaactcttctgagcaagagaagg

SEQ ID NO: 358 - DNA, 27 bp, Artificial Sequence
  Description of Artificial Sequence: Synthetic oligonucleotide
caaggatggaagtgcagttagggctgg

SEQ ID NO: 359 - DNA, 27 bp, Artificial Sequence
  Description of Artificial Sequence: Synthetic oligonucleotide
ccgaggagctttccagaatctgttcca

SEQ ID NO: 360 - DNA, 27 bp, Artificial Sequence
  Description of Artificial Sequence: Synthetic oligonucleotide
cgaggagctttccagaatctgttccag

SEQ ID NO: 361 - DNA, 27 bp, Artificial Sequence
  Description of Artificial Sequence: Synthetic oligonucleotide
cgctgaccttaaagacatcctgagcga

SEQ ID NO: 362 - DNA, 27 bp, Artificial Sequence
  Description of Artificial Sequence: Synthetic oligonucleotide
tccaaggacaattacttagggggcact

SEQ ID NO: 363 - DNA, 27 bp, Artificial Sequence
  Description of Artificial Sequence: Synthetic oligonucleotide
ccaaggagttgtgtaaggcagtgtcgg

SEQ ID NO: 364 - DNA, 27 bp, Artificial Sequence
  Description of Artificial Sequence: Synthetic oligonucleotide
cactgaagatactgctgagtattcccc

SEQ ID NO: 365 - DNA, 27 bp, Artificial Sequence
  Description of Artificial Sequence: Synthetic oligonucleotide
tgctgagtattcccctttcaagggagg

SEQ ID NO: 366 - DNA, 27 bp, Artificial Sequence
  Description of Artificial Sequence: Synthetic oligonucleotide
cacttgtgtcaaaagcgaaatgggccc

SEQ ID NO: 367 - DNA, 27 bp, Artificial Sequence
  Description of Artificial Sequence: Synthetic oligonucleotide
acttgtgtcaaaagcgaaatgggcccc

SEQ ID NO: 368 - DNA, 27 bp, Artificial Sequence
  Description of Artificial Sequence: Synthetic oligonucleotide
accatgttttgcccattgactattact

SEQ ID NO: 369 - DNA, 27 bp, Artificial Sequence
  Description of Artificial Sequence: Synthetic oligonucleotide
catgttttgcccattgactattacttt

SEQ ID NO: 370 - DNA, 27 bp, Artificial Sequence
  Description of Artificial Sequence: Synthetic oligonucleotide
ctgtggagatgaagcttctgggtgtca

SEQ ID NO: 371 - DNA, 27 bp, Artificial Sequence
  Description of Artificial Sequence: Synthetic oligonucleotide
tgaagggaaacagaagtacctgtgcgc

SEQ ID NO: 372 - DNA, 27 bp, Artificial Sequence
  Description of Artificial Sequence: Synthetic oligonucleotide
gcagaaatgattgcactattgataaat

SEQ ID NO: 373 - DNA, 27 bp, Artificial Sequence
  Description of Artificial Sequence: Synthetic oligonucleotide
cagaaatgattgcactattgataaatt

SEQ ID NO: 374 - DNA, 27 bp, Artificial Sequence
  Description of Artificial Sequence: Synthetic oligonucleotide
agaaatgattgcactattgataaattc

SEQ ID NO: 375 - DNA, 27 bp, Artificial Sequence
  Description of Artificial Sequence: Synthetic oligonucleotide
aaatgattgcactattgataaattccg

SEQ ID NO: 376 - DNA, 27 bp, Artificial Sequence
  Description of Artificial Sequence: Synthetic oligonucleotide
aatgattgcactattgataaattccga

SEQ ID NO: 377 - DNA, 27 bp, Artificial Sequence
  Description of Artificial Sequence: Synthetic oligonucleotide
cactattgataaattccgaaggaaaaa

SEQ ID NO: 378 - DNA, 27 bp, Artificial Sequence
  Description of Artificial Sequence: Synthetic oligonucleotide
actattgataaattccgaaggaaaaat

SEQ ID NO: 379 - DNA, 27 bp, Artificial Sequence
  Description of Artificial Sequence: Synthetic oligonucleotide
ctattgataaattccgaaggaaaaatt

SEQ ID NO: 380 - DNA, 27 bp, Artificial Sequence
  Description of Artificial Sequence: Synthetic oligonucleotide
tattgataaattccgaaggaaaaattg

SEQ ID NO: 381 - DNA, 27 bp, Artificial Sequence
  Description of Artificial Sequence: Synthetic oligonucleotide
attgataaattccgaaggaaaaattgt

SEQ ID NO: 382 - DNA, 27 bp, Artificial Sequence
  Description of Artificial Sequence: Synthetic oligonucleotide
tgataaattccgaaggaaaaattgtcc

SEQ ID NO: 383 - DNA, 27 bp, Artificial Sequence
  Description of Artificial Sequence: Synthetic oligonucleotide
gataaattccgaaggaaaaattgtcca

SEQ ID NO: 384 - DNA, 27 bp, Artificial Sequence
  Description of Artificial Sequence: Synthetic oligonucleotide
cgaaggaaaaattgtccatcttgtcgt

SEQ ID NO: 385 - DNA, 27 bp, Artificial Sequence
  Description of Artificial Sequence: Synthetic oligonucleotide
atcttgtcgtcttcggaaatgttatga

SEQ ID NO: 386 - DNA, 27 bp, Artificial Sequence
  Description of Artificial Sequence: Synthetic oligonucleotide
cggaaatgttatgaagcagggatgact

SEQ ID NO: 387 - DNA, 27 bp, Artificial Sequence
  Description of Artificial Sequence: Synthetic oligonucleotide
gaaatgttatgaagcagggatgactct

SEQ ID NO: 388 - DNA, 27 bp, Artificial Sequence
  Description of Artificial Sequence: Synthetic oligonucleotide
cccggaagctgaagaaacttggtaatc

SEQ ID NO: 389 - DNA, 27 bp, Artificial Sequence
  Description of Artificial Sequence: Synthetic oligonucleotide
cggaagctgaagaaacttggtaatctg

SEQ ID NO: 390 - DNA, 27 bp, Artificial Sequence
  Description of Artificial Sequence: Synthetic oligonucleotide
gctgaagaaacttggtaatctgaaact

SEQ ID NO: 391 - DNA, 27 bp, Artificial Sequence
  Description of Artificial Sequence: Synthetic oligonucleotide
ctgaagaaacttggtaatctgaaacta

SEQ ID NO: 392 - DNA, 27 bp, Artificial Sequence
  Description of Artificial Sequence: Synthetic oligonucleotide
tgaagaaacttggtaatctgaaactac

SEQ ID NO: 393 - DNA, 27 bp, Artificial Sequence
  Description of Artificial Sequence: Synthetic oligonucleotide
ttggtaatctgaaactacaggaggaag

SEQ ID NO: 394 - DNA, 27 bp, Artificial Sequence
  Description of Artificial Sequence: Synthetic oligonucleotide
atctgaaactacaggaggaaggagagg

SEQ ID NO: 395 - DNA, 27 bp, Artificial Sequence
  Description of Artificial Sequence: Synthetic oligonucleotide
cccaggaattcctgtgcatgaaagcac

SEQ ID NO: 396 - DNA, 27 bp, Artificial Sequence
  Description of Artificial Sequence: Synthetic oligonucleotide
ccaggaattcctgtgcatgaaagcact

SEQ ID NO: 397 - DNA, 27 bp, Artificial Sequence
  Description of Artificial Sequence: Synthetic oligonucleotide
gtggatgggctgaaaaatcaaaaattc

SEQ ID NO: 398 - DNA, 27 bp, Artificial Sequence
  Description of Artificial Sequence: Synthetic oligonucleotide
tggatgggctgaaaaatcaaaaattct

SEQ ID NO: 399 - DNA, 27 bp, Artificial Sequence
  Description of Artificial Sequence: Synthetic oligonucleotide
gatgggctgaaaaatcaaaaattcttt

SEQ ID NO: 400 - DNA, 27 bp, Artificial Sequence
  Description of Artificial Sequence: Synthetic oligonucleotide
ggctgaaaaatcaaaaattctttgatg

SEQ ID NO: 401 - DNA, 27 bp, Artificial Sequence
  Description of Artificial Sequence: Synthetic oligonucleotide
gctgaaaaatcaaaaattctttgatga

SEQ ID NO: 402 - DNA, 27 bp, Artificial Sequence
  Description of Artificial Sequence: Synthetic oligonucleotide
tgaaaaatcaaaaattctttgatgaac

SEQ ID NO: 403 - DNA, 27 bp, Artificial Sequence
  Description of Artificial Sequence: Synthetic oligonucleotide
gaaaaatcaaaaattctttgatgaact

SEQ ID NO: 404 - DNA, 27 bp, Artificial Sequence
  Description of Artificial Sequence: Synthetic oligonucleotide
aaaaatcaaaaattctttgatgaactt

SEQ ID NO: 405 - DNA, 27 bp, Artificial Sequence
  Description of Artificial Sequence: Synthetic oligonucleotide
ttcgaatgaactacatcaaggaactcg

SEQ ID NO: 406 - DNA, 27 bp, Artificial Sequence
  Description of Artificial Sequence: Synthetic oligonucleotide
tcaaggaactcgatcgtatcattgcat

SEQ ID NO: 407 - DNA, 27 bp, Artificial Sequence
  Description of Artificial Sequence: Synthetic oligonucleotide
caaggaactcgatcgtatcattgcatg

SEQ ID NO: 408 - DNA, 27 bp, Artificial Sequence
  Description of Artificial Sequence: Synthetic oligonucleotide
atcgtatcattgcatgcaaaagaaaaa

SEQ ID NO: 409 - DNA, 27 bp, Artificial Sequence
  Description of Artificial Sequence: Synthetic oligonucleotide
tcgtatcattgcatgcaaaagaaaaaa

SEQ ID NO: 410 - DNA, 27 bp, Artificial Sequence
  Description of Artificial Sequence: Synthetic oligonucleotide
atcattgcatgcaaaagaaaaaatccc

SEQ ID NO: 411 - DNA, 27 bp, Artificial Sequence
  Description of Artificial Sequence: Synthetic oligonucleotide
cacttttgacctgctaatcaagtcaca

SEQ ID NO: 412 - DNA, 27 bp, Artificial Sequence
  Description of Artificial Sequence: Synthetic oligonucleotide
gcgtggactttccggaaatgatggcag

SEQ ID NO: 413 - DNA, 27 bp, Artificial Sequence
  Description of Artificial Sequence: Synthetic oligonucleotide
cgtggactttccggaaatgatggcaga

SEQ ID NO: 414 - DNA, 27 bp, Artificial Sequence
  Description of Artificial Sequence: Synthetic oligonucleotide
tgatggcagagatcatctctgtgcaag

SEQ ID NO: 415 - DNA, 27 bp, Artificial Sequence
  Description of Artificial Sequence: Synthetic oligonucleotide
gcagagatcatctctgtgcaagtgccc

SEQ ID NO: 416 - DNA, 27 bp, Artificial Sequence
  Description of Artificial Sequence: Synthetic oligonucleotide
cagagatcatctctgtgcaagtgccca

SEQ ID NO: 417 - DNA, 27 bp, Artificial Sequence
  Description of Artificial Sequence: Synthetic oligonucleotide
cccaagatcctttctgggaaagtcaag

SEQ ID NO: 418 - DNA, 27 bp, Artificial Sequence
  Description of Artificial Sequence: Synthetic oligonucleotide
gtgaagcattggaaaccctatttcccc

SEQ ID NO: 419 - DNA, 27 bp, Artificial Sequence
  Description of Artificial Sequence: Synthetic oligonucleotide
cagatgtcttctgcctgttataactct

SEQ ID NO: 420 - DNA, 27 bp, Artificial Sequence
  Description of Artificial Sequence: Synthetic oligonucleotide
gccttggggaatttcctctattgatgt

SEQ ID NO: 421 - DNA, 27 bp, Artificial Sequence
  Description of Artificial Sequence: Synthetic oligonucleotide
cttggggaatttcctctattgatgtac

SEQ ID NO: 422 - DNA, 27 bp, Artificial Sequence
  Description of Artificial Sequence: Synthetic oligonucleotide
ttggggaatttcctctattgatgtaca

SEQ ID NO: 423 - DNA, 27 bp, Artificial Sequence
  Description of Artificial Sequence: Synthetic oligonucleotide
tggggaatttcctctattgatgtacag

SEQ ID NO: 424 - DNA, 27 bp, Artificial Sequence
  Description of Artificial Sequence: Synthetic oligonucleotide
ggggaatttcctctattgatgtacagt

SEQ ID NO: 425 - DNA, 27 bp, Artificial Sequence
  Description of Artificial Sequence: Synthetic oligonucleotide
ctattgatgtacagtctgtcatgaaca

SEQ ID NO: 426 - DNA, 27 bp, Artificial Sequence
  Description of Artificial Sequence: Synthetic oligonucleotide
tattgatgtacagtctgtcatgaacat

SEQ ID NO: 427 - DNA, 27 bp, Artificial Sequence
  Description of Artificial Sequence: Synthetic oligonucleotide
attgatgtacagtctgtcatgaacatg

SEQ ID NO: 428 - DNA, 27 bp, Artificial Sequence
  Description of Artificial Sequence: Synthetic oligonucleotide
aacatgttcctgaattctatttgctgg

SEQ ID NO: 429 - DNA, 27 bp, Artificial Sequence
  Description of Artificial Sequence: Synthetic oligonucleotide
ttctatttgctgggctttttttttctc

SEQ ID NO: 430 - DNA, 27 bp, Artificial Sequence
  Description of Artificial Sequence: Synthetic oligonucleotide
tctatttgctgggctttttttttctct

SEQ ID NO: 431 - DNA, 27 bp, Artificial Sequence
  Description of Artificial Sequence: Synthetic oligonucleotide
tgctgggctttttttttctctttctct

SEQ ID NO: 432 - DNA, 27 bp, Artificial Sequence
  Description of Artificial Sequence: Synthetic oligonucleotide
ttttttttctctttctctcctttcttt

SEQ ID NO: 433 - DNA, 27 bp, Artificial Sequence
  Description of Artificial Sequence: Synthetic oligonucleotide
ttcagactttgcttcccattgtggctc

SEQ ID NO: 434 - DNA, 27 bp, Artificial Sequence
  Description of Artificial Sequence: Synthetic oligonucleotide
ttgtggctcctatctgtgttttgaatg

SEQ ID NO: 435 - DNA, 27 bp, Artificial Sequence
  Description of Artificial Sequence: Synthetic oligonucleotide
tcctatctgtgttttgaatggtgttgt

SEQ ID NO: 436 - DNA, 27 bp, Artificial Sequence
  Description of Artificial Sequence: Synthetic oligonucleotide
atctgtgttttgaatggtgttgtatgc

SEQ ID NO: 437 - DNA, 27 bp, Artificial Sequence
  Description of Artificial Sequence: Synthetic oligonucleotide
tgtgttttgaatggtgttgtatgcctt

SEQ ID NO: 438 - DNA, 27 bp, Artificial Sequence
  Description of Artificial Sequence: Synthetic oligonucleotide
tgaatggtgttgtatgcctttaaatct

SEQ ID NO: 439 - DNA, 27 bp, Artificial Sequence
  Description of Artificial Sequence: Synthetic oligonucleotide
gaatggtgttgtatgcctttaaatctg

SEQ ID NO: 440 - DNA, 27 bp, Artificial Sequence
  Description of Artificial Sequence: Synthetic oligonucleotide
tgttgtatgcctttaaatctgtgatga

SEQ ID NO: 441 - DNA, 27 bp, Artificial Sequence
  Description of Artificial Sequence: Synthetic oligonucleotide
ttgtatgcctttaaatctgtgatgatc

SEQ ID NO: 442 - DNA, 27 bp, Artificial Sequence
  Description of Artificial Sequence: Synthetic oligonucleotide
tgtatgcctttaaatctgtgatgatcc

SEQ ID NO: 443 - DNA, 27 bp, Artificial Sequence
  Description of Artificial Sequence: Synthetic oligonucleotide
cccagtgtcaagttgtgcttgtttaca

SEQ ID NO: 444 - DNA, 27 bp, Artificial Sequence
  Description of Artificial Sequence: Synthetic oligonucleotide
ccagtgtcaagttgtgcttgtttacag

SEQ ID NO: 445 - DNA, 27 bp, Artificial Sequence
  Description of Artificial Sequence: Synthetic oligonucleotide
gcttgtttacagcactactctgtgcca

SEQ ID NO: 446 - DNA, 27 bp, Artificial Sequence
  Description of Artificial Sequence: Synthetic oligonucleotide
cttgtttacagcactactctgtgccag

SEQ ID NO: 447 - DNA, 27 bp, Artificial Sequence
  Description of Artificial Sequence: Synthetic oligonucleotide
cacaaacgtttacttatcttatgccac

SEQ ID NO: 448 - DNA, 27 bp, Artificial Sequence
  Description of Artificial Sequence: Synthetic oligonucleotide
cacgggaagtttagagagctaagatta

SEQ ID NO: 449 - DNA, 27 bp, Artificial Sequence
  Description of Artificial Sequence: Synthetic oligonucleotide
acgggaagtttagagagctaagattat

SEQ ID NO: 450 - DNA, 27 bp, Artificial Sequence
  Description of Artificial Sequence: Synthetic oligonucleotide
cgggaagtttagagagctaagattatc

SEQ ID NO: 451 - DNA, 27 bp, Artificial Sequence
  Description of Artificial Sequence: Synthetic oligonucleotide
gggaagtttagagagctaagattatct

SEQ ID NO: 452 - DNA, 27 bp, Artificial Sequence
  Description of Artificial Sequence: Synthetic oligonucleotide
gaagtttagagagctaagattatctgg

SEQ ID NO: 453 - DNA, 27 bp, Artificial Sequence
  Description of Artificial Sequence: Synthetic oligonucleotide
ttagagagctaagattatctggggaaa

SEQ ID NO: 454 - DNA, 27 bp, Artificial Sequence
  Description of Artificial Sequence: Synthetic oligonucleotide
tagagagctaagattatctggggaaat

SEQ ID NO: 455 - DNA, 27 bp, Artificial Sequence
  Description of Artificial Sequence: Synthetic oligonucleotide
agagagctaagattatctggggaaatc

SEQ ID NO: 456 - DNA, 27 bp, Artificial Sequence
  Description of Artificial Sequence: Synthetic oligonucleotide
taagattatctggggaaatcaaaacaa

SEQ ID NO: 457 - DNA, 27 bp, Artificial Sequence
  Description of Artificial Sequence: Synthetic oligonucleotide
aagattatctggggaaatcaaaacaaa

SEQ ID NO: 458 - DNA, 27 bp, Artificial Sequence
  Description of Artificial Sequence: Synthetic oligonucleotide
atctggggaaatcaaaacaaaaacaag

SEQ ID NO: 459 - DNA, 27 bp, Artificial Sequence
  Description of Artificial Sequence: Synthetic oligonucleotide
ggggaaatcaaaacaaaaacaagcaaa

SEQ ID NO: 460 - RNA, 25 nt, Artificial Sequence
  Description of Artificial Sequence: Synthetic oligonucleotide
aaguuuuuaaaagcugcuaaagacu

SEQ ID NO: 461 - RNA, 25 nt, Artificial Sequence
  Description of Artificial Sequence: Synthetic oligonucleotide
aguuuuuaaaagcugcuaaagacuc

SEQ ID NO: 462 - RNA, 25 nt, Artificial Sequence
  Description of Artificial Sequence: Synthetic oligonucleotide
guuuuuaaaagcugcuaaagacucg

SEQ ID NO: 463 - RNA, 25 nt, Artificial Sequence
  Description of Artificial Sequence: Synthetic oligonucleotide
cggagccagagaucaaaagaugaaa

SEQ ID NO: 464 - RNA, 25 nt, Artificial Sequence
  Description of Artificial Sequence: Synthetic oligonucleotide
cagagaucaaaagaugaaaaggcag

SEQ ID NO: 465 - RNA, 25 nt, Artificial Sequence
  Description of Artificial Sequence: Synthetic oligonucleotide
agagaucaaaagaugaaaaggcagu

SEQ ID NO: 466 - RNA, 25 nt, Artificial Sequence
  Description of Artificial Sequence: Synthetic oligonucleotide
aaagaugaaaaggcagucaggucuu

SEQ ID NO: 467 - RNA, 25 nt, Artificial Sequence
  Description of Artificial Sequence: Synthetic oligonucleotide
aagaugaaaaggcagucaggucuuc

SEQ ID NO: 468 - RNA, 25 nt, Artificial Sequence
  Description of Artificial Sequence: Synthetic oligonucleotide
caggucuucaguagccaaaaaacaa

SEQ ID NO: 469 - RNA, 25 nt, Artificial Sequence
  Description of Artificial Sequence: Synthetic oligonucleotide
aggucuucaguagccaaaaaacaaa

SEQ ID NO: 470 - RNA, 25 nt, Artificial Sequence
  Description of Artificial Sequence: Synthetic oligonucleotide
guagccaaaaaacaaaacaaacaaa

SEQ ID NO: 471 - RNA, 25 nt, Artificial Sequence
  Description of Artificial Sequence: Synthetic oligonucleotide
caaaaaacaaaacaaacaaaaacaa

SEQ ID NO: 472 - RNA, 25 nt, Artificial Sequence
  Description of Artificial Sequence: Synthetic oligonucleotide
aaaaaacaaaacaaacaaaaacaaa

SEQ ID NO: 473 - RNA, 25 nt, Artificial Sequence
  Description of Artificial Sequence: Synthetic oligonucleotide
aaaacaaacaaaaacaaaaaagccg

SEQ ID NO: 474 - RNA, 25 nt, Artificial Sequence
  Description of Artificial Sequence: Synthetic oligonucleotide
caaaaacaaaaaagccgaaauaaaa

SEQ ID NO: 475 - RNA, 25 nt, Artificial Sequence
  Description of Artificial Sequence: Synthetic oligonucleotide
aaaaacaaaaaagccgaaauaaaag

SEQ ID NO: 476 - RNA, 25 nt, Artificial Sequence
  Description of Artificial Sequence: Synthetic oligonucleotide
aaaacaaaaaagccgaaauaaaaga

SEQ ID NO: 477 - RNA, 25 nt, Artificial Sequence
  Description of Artificial Sequence: Synthetic oligonucleotide
aaaaaagccgaaauaaaagaaaaag

SEQ ID NO: 478 - RNA, 25 nt, Artificial Sequence
  Description of Artificial Sequence: Synthetic oligonucleotide
aaaaagccgaaauaaaagaaaaaga

SEQ ID NO: 479 - RNA, 25 nt, Artificial Sequence
  Description of Artificial Sequence: Synthetic oligonucleotide
aaagccgaaauaaaagaaaaagaua

SEQ ID NO: 480 - RNA, 25 nt, Artificial Sequence
  Description of Artificial Sequence: Synthetic oligonucleotide
cgaaauaaaagaaaaagauaauaac

SEQ ID NO: 481 - RNA, 25 nt, Artificial Sequence
  Description of Artificial Sequence: Synthetic oligonucleotide
gaaauaaaagaaaaagauaauaacu

SEQ ID NO: 482 - RNA, 25 nt, Artificial Sequence
  Description of Artificial Sequence: Synthetic oligonucleotide
aaauaaaagaaaaagauaauaacuc

SEQ ID NO: 483 - RNA, 25 nt, Artificial Sequence
  Description of Artificial Sequence: Synthetic oligonucleotide
gaaaaagauaauaacucaguucuua

SEQ ID NO: 484 - RNA, 25 nt, Artificial Sequence
  Description of Artificial Sequence: Synthetic oligonucleotide
aagauaauaacucaguucuuauuug

SEQ ID NO: 485 - RNA, 25 nt, Artificial Sequence
  Description of Artificial Sequence: Synthetic oligonucleotide
agauaauaacucaguucuuauuugc

SEQ ID NO: 486 - RNA, 25 nt, Artificial Sequence
  Description of Artificial Sequence: Synthetic oligonucleotide
auaauaacucaguucuuauuugcac

SEQ ID NO: 487 - RNA, 25 nt, Artificial Sequence
  Description of Artificial Sequence: Synthetic oligonucleotide
uaauaacucaguucuuauuugcacc

SEQ ID NO: 488 - RNA, 25 nt, Artificial Sequence
  Description of Artificial Sequence: Synthetic oligonucleotide
uuauuugcaccuacuucaguggaca

SEQ ID NO: 489 - RNA, 25 nt, Artificial Sequence
  Description of Artificial Sequence: Synthetic oligonucleotide
aguggacacugaauuuggaaggugg

SEQ ID NO: 490 - RNA, 25 nt, Artificial Sequence
  Description of Artificial Sequence: Synthetic oligonucleotide
cugaauuuggaagguggaggauuuu

SEQ ID NO: 491 - RNA, 25 nt, Artificial Sequence
  Description of Artificial Sequence: Synthetic oligonucleotide
uggaagguggaggauuuuguuuuuu

SEQ ID NO: 492 - RNA, 25 nt, Artificial Sequence
  Description of Artificial Sequence: Synthetic oligonucleotide
aagguggaggauuuuguuuuuuucu

SEQ ID NO: 493 - RNA, 25 nt, Artificial Sequence
  Description of Artificial Sequence: Synthetic oligonucleotide
gaggauuuuguuuuuuucuuuuaag

SEQ ID NO: 494 - RNA, 25 nt, Artificial Sequence
  Description of Artificial Sequence: Synthetic oligonucleotide
aggauuuuguuuuuuucuuuuaaga

SEQ ID NO: 495 - RNA, 25 nt, Artificial Sequence
  Description of Artificial Sequence: Synthetic oligonucleotide
gauuuuguuuuuuucuuuuaagauc

SEQ ID NO: 496 - RNA, 25 nt, Artificial Sequence
  Description of Artificial Sequence: Synthetic oligonucleotide
auuuuguuuuuuucuuuuaagaucu

SEQ ID NO: 497 - RNA, 25 nt, Artificial Sequence
  Description of Artificial Sequence: Synthetic oligonucleotide
uuuuguuuuuuucuuuuaagaucug

SEQ ID NO: 498 - RNA, 25 nt, Artificial Sequence
  Description of Artificial Sequence: Synthetic oligonucleotide
uuuguuuuuuucuuuuaagaucugg

SEQ ID NO: 499 - RNA, 25 nt, Artificial Sequence
  Description of Artificial Sequence: Synthetic oligonucleotide
uuuuuuucuuuuaagaucugggcau

SEQ ID NO: 500 - RNA, 25 nt, Artificial Sequence
  Description of Artificial Sequence: Synthetic oligonucleotide
uuuuuucuuuuaagaucugggcauc

SEQ ID NO: 501 - RNA, 25 nt, Artificial Sequence
  Description of Artificial Sequence: Synthetic oligonucleotide
uaagaucugggcaucuuuugaaucu

SEQ ID NO: 502 - RNA, 25 nt, Artificial Sequence
  Description of Artificial Sequence: Synthetic oligonucleotide
cuuuugaaucuacccuucaaguauu

SEQ ID NO: 503 - RNA, 25 nt, Artificial Sequence
  Description of Artificial Sequence: Synthetic oligonucleotide
uuuugaaucuacccuucaaguauua

SEQ ID NO: 504 - RNA, 25 nt, Artificial Sequence
  Description of Artificial Sequence: Synthetic oligonucleotide
uuugaaucuacccuucaaguauuaa

SEQ ID NO: 505 - RNA, 25 nt, Artificial Sequence
  Description of Artificial Sequence: Synthetic oligonucleotide
uugaaucuacccuucaaguauuaag

SEQ ID NO: 506 - RNA, 25 nt, Artificial Sequence
  Description of Artificial Sequence: Synthetic oligonucleotide
ugaaucuacccuucaaguauuaaga

SEQ ID NO: 507 - RNA, 25 nt, Artificial Sequence
  Description of Artificial Sequence: Synthetic oligonucleotide
aaguauuaagagacagacugugagc

SEQ ID NO: 508 - RNA, 25 nt, Artificial Sequence
  Description of Artificial Sequence: Synthetic oligonucleotide
uauuaagagacagacugugagccua

SEQ ID NO: 509 - RNA, 25 nt, Artificial Sequence
  Description of Artificial Sequence: Synthetic oligonucleotide
guugaacucuucugagcaagagaag

SEQ ID NO: 510 - RNA, 25 nt, Artificial Sequence
  Description of Artificial Sequence: Synthetic oligonucleotide
uugaacucuucugagcaagagaagg

SEQ ID NO: 511 - RNA, 25 nt, Artificial Sequence
  Description of Artificial Sequence: Synthetic oligonucleotide
aggauggaagugcaguuagggcugg

SEQ ID NO: 512 - RNA, 25 nt, Artificial Sequence
  Description of Artificial Sequence: Synthetic oligonucleotide
gaggagcuuuccagaaucuguucca

SEQ ID NO: 513 - RNA, 25 nt, Artificial Sequence
  Description of Artificial Sequence: Synthetic oligonucleotide
aggagcuuuccagaaucuguuccag

SEQ ID NO: 514 - RNA, 25 nt, Artificial Sequence
  Description of Artificial Sequence: Synthetic oligonucleotide
cugaccuuaaagacauccugagcga

SEQ ID NO: 515 - RNA, 25 nt, Artificial Sequence
  Description of Artificial Sequence: Synthetic oligonucleotide
caaggacaauuacuuagggggcacu

SEQ ID NO: 516 - RNA, 25 nt, Artificial Sequence
  Description of Artificial Sequence: Synthetic oligonucleotide
aaggaguuguguaaggcagugucgg

SEQ ID NO: 517 - RNA, 25 nt, Artificial Sequence
  Description of Artificial Sequence: Synthetic oligonucleotide
cugaagauacugcugaguauucccc

SEQ ID NO: 518 - RNA, 25 nt, Artificial Sequence
  Description of Artificial Sequence: Synthetic oligonucleotide
cugaguauuccccuuucaagggagg

SEQ ID NO: 519 - RNA, 25 nt, Artificial Sequence
  Description of Artificial Sequence: Synthetic oligonucleotide
cuugugucaaaagcgaaaugggccc

SEQ ID NO: 520 - RNA, 25 nt, Artificial Sequence
  Description of Artificial Sequence: Synthetic oligonucleotide
uugugucaaaagcgaaaugggcccc

SEQ ID NO: 521 - RNA, 25 nt, Artificial Sequence
  Description of Artificial Sequence: Synthetic oligonucleotide
cauguuuugcccauugacuauuacu

SEQ ID NO: 522 - RNA, 25 nt, Artificial Sequence
  Description of Artificial Sequence: Synthetic oligonucleotide
uguuuugcccauugacuauuacuuu

SEQ ID NO: 523 - RNA, 25 nt, Artificial Sequence
  Description of Artificial Sequence: Synthetic oligonucleotide
guggagaugaagcuucuggguguca

SEQ ID NO: 524 - RNA, 25 nt, Artificial Sequence
  Description of Artificial Sequence: Synthetic oligonucleotide
aagggaaacagaaguaccugugcgc

SEQ ID NO: 525 - RNA, 25 nt, Artificial Sequence
  Description of Artificial Sequence: Synthetic oligonucleotide
agaaaugauugcacuauugauaaau

SEQ ID NO: 526 - RNA, 25 nt, Artificial Sequence
  Description of Artificial Sequence: Synthetic oligonucleotide
gaaaugauugcacuauugauaaauu

SEQ ID NO: 527 - RNA, 25 nt, Artificial Sequence
  Description of Artificial Sequence: Synthetic oligonucleotide
aaaugauugcacuauugauaaauuc

SEQ ID NO: 528 - RNA, 25 nt, Artificial Sequence
  Description of Artificial Sequence: Synthetic oligonucleotide
augauugcacuauugauaaauuccg

SEQ ID NO: 529 - RNA, 25 nt, Artificial Sequence
  Description of Artificial Sequence: Synthetic oligonucleotide
ugauugcacuauugauaaauuccga

SEQ ID NO: 530 - RNA, 25 nt, Artificial Sequence
  Description of Artificial Sequence: Synthetic oligonucleotide
cuauugauaaauuccgaaggaaaaa

SEQ ID NO: 531 - RNA, 25 nt, Artificial Sequence
  Description of Artificial Sequence: Synthetic oligonucleotide
uauugauaaauuccgaaggaaaaau

SEQ ID NO: 532 - RNA, 25 nt, Artificial Sequence
  Description of Artificial Sequence: Synthetic oligonucleotide
auugauaaauuccgaaggaaaaauu

SEQ ID NO: 533 - RNA, 25 nt, Artificial Sequence
  Description of Artificial Sequence: Synthetic oligonucleotide
uugauaaauuccgaaggaaaaauug

SEQ ID NO: 534 - RNA, 25 nt, Artificial Sequence
  Description of Artificial Sequence: Synthetic oligonucleotide
ugauaaauuccgaaggaaaaauugu

SEQ ID NO: 535 - RNA, 25 nt, Artificial Sequence
  Description of Artificial Sequence: Synthetic oligonucleotide
auaaauuccgaaggaaaaauugucc

SEQ ID NO: 536 - RNA, 25 nt, Artificial Sequence
  Description of Artificial Sequence: Synthetic oligonucleotide
uaaauuccgaaggaaaaauugucca

SEQ ID NO: 537 - RNA, 25 nt, Artificial Sequence
  Description of Artificial Sequence: Synthetic oligonucleotide
aaggaaaaauuguccaucuugucgu

SEQ ID NO: 538 - RNA, 25 nt, Artificial Sequence
  Description of Artificial Sequence: Synthetic oligonucleotide
cuugucgucuucggaaauguuauga

SEQ ID NO: 539 - RNA, 25 nt, Artificial Sequence
  Description of Artificial Sequence: Synthetic oligonucleotide
gaaauguuaugaagcagggaugacu

SEQ ID NO: 540 - RNA, 25 nt, Artificial Sequence
  Description of Artificial Sequence: Synthetic oligonucleotide
aauguuaugaagcagggaugacucu

SEQ ID NO: 541 - RNA, 25 nt, Artificial Sequence
  Description of Artificial Sequence: Synthetic oligonucleotide
cggaagcugaagaaacuugguaauc

SEQ ID NO: 542 - RNA, 25 nt, Artificial Sequence
  Description of Artificial Sequence: Synthetic oligonucleotide
gaagcugaagaaacuugguaaucug

SEQ ID NO: 543 - RNA, 25 nt, Artificial Sequence
  Description of Artificial Sequence: Synthetic oligonucleotide
ugaagaaacuugguaaucugaaacu

SEQ ID NO: 544 - RNA, 25 nt, Artificial Sequence
  Description of Artificial Sequence: Synthetic oligonucleotide
gaagaaacuugguaaucugaaacua

SEQ ID NO: 545 - RNA, 25 nt, Artificial Sequence
  Description of Artificial Sequence: Synthetic oligonucleotide
aagaaacuugguaaucugaaacuac

SEQ ID NO: 546 - RNA, 25 nt, Artificial Sequence
  Description of Artificial Sequence: Synthetic oligonucleotide
gguaaucugaaacuacaggaggaag

SEQ ID NO: 547 - RNA, 25 nt, Artificial Sequence
  Description of Artificial Sequence: Synthetic oligonucleotide
cugaaacuacaggaggaaggagagg

SEQ ID NO: 548 - RNA, 25 nt, Artificial Sequence
  Description of Artificial Sequence: Synthetic oligonucleotide
caggaauuccugugcaugaaagcac

SEQ ID NO: 549 - RNA, 25 nt, Artificial Sequence
  Description of Artificial Sequence: Synthetic oligonucleotide
aggaauuccugugcaugaaagcacu

SEQ ID NO: 550 - RNA, 25 nt, Artificial Sequence
  Description of Artificial Sequence: Synthetic oligonucleotide
ggaugggcugaaaaaucaaaaauuc

SEQ ID NO: 551 - RNA, 25 nt, Artificial Sequence
  Description of Artificial Sequence: Synthetic oligonucleotide
gaugggcugaaaaaucaaaaauucu

SEQ ID NO: 552 - RNA, 25 nt, Artificial Sequence
  Description of Artificial Sequence: Synthetic oligonucleotide
ugggcugaaaaaucaaaaauucuuu

SEQ ID NO: 553 - RNA, 25 nt, Artificial Sequence
  Description of Artificial Sequence: Synthetic oligonucleotide
cugaaaaaucaaaaauucuuugaug

SEQ ID NO: 554 - RNA, 25 nt, Artificial Sequence
  Description of Artificial Sequence: Synthetic oligonucleotide
ugaaaaaucaaaaauucuuugauga

SEQ ID NO: 555 - RNA, 25 nt, Artificial Sequence
  Description of Artificial Sequence: Synthetic oligonucleotide
aaaaaucaaaaauucuuugaugaac

SEQ ID NO: 556 - RNA, 25 nt, Artificial Sequence
  Description of Artificial Sequence: Synthetic oligonucleotide
aaaaucaaaaauucuuugaugaacu

SEQ ID NO: 557 - RNA, 25 nt, Artificial Sequence
  Description of Artificial Sequence: Synthetic oligonucleotide
aaaucaaaaauucuuugaugaacuu

SEQ ID NO: 558 - RNA, 25 nt, Artificial Sequence
  Description of Artificial Sequence: Synthetic oligonucleotide
cgaaugaacuacaucaaggaacucg

SEQ ID NO: 559 - RNA, 25 nt, Artificial Sequence
  Description of Artificial Sequence: Synthetic oligonucleotide
aaggaacucgaucguaucauugcau

SEQ ID NO: 560 - RNA, 25 nt, Artificial Sequence
  Description of Artificial Sequence: Synthetic oligonucleotide
aggaacucgaucguaucauugcaug

SEQ ID NO: 561 - RNA, 25 nt, Artificial Sequence
  Description of Artificial Sequence: Synthetic oligonucleotide
cguaucauugcaugcaaaagaaaaa

SEQ ID NO: 562 - RNA, 25 nt, Artificial Sequence
  Description of Artificial Sequence: Synthetic oligonucleotide
guaucauugcaugcaaaagaaaaaa

SEQ ID NO: 563 - RNA, 25 nt, Artificial Sequence
  Description of Artificial Sequence: Synthetic oligonucleotide
cauugcaugcaaaagaaaaaauccc

SEQ ID NO: 564 - RNA, 25 nt, Artificial Sequence
  Description of Artificial Sequence: Synthetic oligonucleotide
cuuuugaccugcuaaucaagucaca

SEQ ID NO: 565 - RNA, 25 nt, Artificial Sequence
  Description of Artificial Sequence: Synthetic oligonucleotide
guggacuuuccggaaaugauggcag

SEQ ID NO: 566 - RNA, 25 nt, Artificial Sequence
  Description of Artificial Sequence: Synthetic oligonucleotide
uggacuuuccggaaaugauggcaga

SEQ ID NO: 567 - RNA, 25 nt, Artificial Sequence
  Description of Artificial Sequence: Synthetic oligonucleotide
auggcagagaucaucucugugcaag

SEQ ID NO: 568 - RNA, 25 nt, Artificial Sequence
  Description of Artificial Sequence: Synthetic oligonucleotide
agagaucaucucugugcaagugccc

SEQ ID NO: 569 - RNA, 25 nt, Artificial Sequence
  Description of Artificial Sequence: Synthetic oligonucleotide
gagaucaucucugugcaagugccca

SEQ ID NO: 570 - RNA, 25 nt, Artificial Sequence
  Description of Artificial Sequence: Synthetic oligonucleotide
caagauccuuucugggaaagucaag

SEQ ID NO: 571 - RNA, 25 nt, Artificial Sequence
  Description of Artificial Sequence: Synthetic oligonucleotide
gaagcauuggaaacccuauuucccc

SEQ ID NO: 572 - RNA, 25 nt, Artificial Sequence
  Description of Artificial Sequence: Synthetic oligonucleotide
gaugucuucugccuguuauaacucu

SEQ ID NO: 573 - RNA, 25 nt, Artificial Sequence
  Description of Artificial Sequence: Synthetic oligonucleotide
cuuggggaauuuccucuauugaugu

SEQ ID NO: 574 - RNA, 25 nt, Artificial Sequence
  Description of Artificial Sequence: Synthetic oligonucleotide
uggggaauuuccucuauugauguac

SEQ ID NO: 575 - RNA, 25 nt, Artificial Sequence
  Description of Artificial Sequence: Synthetic oligonucleotide
ggggaauuuccucuauugauguaca

SEQ ID NO: 576 - RNA, 25 nt, Artificial Sequence
  Description of Artificial Sequence: Synthetic oligonucleotide
gggaauuuccucuauugauguacag

SEQ ID NO: 577 - RNA, 25 nt, Artificial Sequence
  Description of Artificial Sequence: Synthetic oligonucleotide
ggaauuuccucuauugauguacagu

SEQ ID NO: 578 - RNA, 25 nt, Artificial Sequence
  Description of Artificial Sequence: Synthetic oligonucleotide
auugauguacagucugucaugaaca

SEQ ID NO: 579 - RNA, 25 nt, Artificial Sequence
  Description of Artificial Sequence: Synthetic oligonucleotide
uugauguacagucugucaugaacau

SEQ ID NO: 580 - RNA, 25 nt, Artificial Sequence
  Description of Artificial Sequence: Synthetic oligonucleotide
ugauguacagucugucaugaacaug

SEQ ID NO: 581 - RNA, 25 nt, Artificial Sequence
  Description of Artificial Sequence: Synthetic oligonucleotide
cauguuccugaauucuauuugcugg

SEQ ID NO: 582 - RNA, 25 nt, Artificial Sequence
  Description of Artificial Sequence: Synthetic oligonucleotide
cuauuugcugggcuuuuuuuuucuc

SEQ ID NO: 583 - RNA, 25 nt, Artificial Sequence
  Description of Artificial Sequence: Synthetic oligonucleotide
uauuugcugggcuuuuuuuuucucu

SEQ ID NO: 584 - RNA, 25 nt, Artificial Sequence
  Description of Artificial Sequence: Synthetic oligonucleotide
cugggcuuuuuuuuucucuuucucu

SEQ ID NO: 585 - RNA, 25 nt, Artificial Sequence
  Description of Artificial Sequence: Synthetic oligonucleotide
uuuuuucucuuucucuccuuucuuu

SEQ ID NO: 586 - RNA, 25 nt, Artificial Sequence
  Description of Artificial Sequence: Synthetic oligonucleotide
cagacuuugcuucccauuguggcuc

SEQ ID NO: 587 - RNA, 25 nt, Artificial Sequence
  Description of Artificial Sequence: Synthetic oligonucleotide
guggcuccuaucuguguuuugaaug

SEQ ID NO: 588 - RNA, 25 nt, Artificial Sequence
  Description of Artificial Sequence: Synthetic oligonucleotide
cuaucuguguuuugaaugguguugu

SEQ ID NO: 589 - RNA, 25 nt, Artificial Sequence
  Description of Artificial Sequence: Synthetic oligonucleotide
cuguguuuugaaugguguuguaugc

SEQ ID NO: 590 - RNA, 25 nt, Artificial Sequence
  Description of Artificial Sequence: Synthetic oligonucleotide
uguuuugaaugguguuguaugccuu

SEQ ID NO: 591 - RNA, 25 nt, Artificial Sequence
  Description of Artificial Sequence: Synthetic oligonucleotide
aaugguguuguaugccuuuaaaucu

SEQ ID NO: 592 - RNA, 25 nt, Artificial Sequence
  Description of Artificial Sequence: Synthetic oligonucleotide
augguguuguaugccuuuaaaucug

SEQ ID NO: 593 - RNA, 25 nt, Artificial Sequence
  Description of Artificial Sequence: Synthetic oligonucleotide
uuguaugccuuuaaaucugugauga

SEQ ID NO: 594 - RNA, 25 nt, Artificial Sequence
  Description of Artificial Sequence: Synthetic oligonucleotide
guaugccuuuaaaucugugaugauc

SEQ ID NO: 595 - RNA, 25 nt, Artificial Sequence
  Description of Artificial Sequence: Synthetic oligonucleotide
uaugccuuuaaaucugugaugaucc

SEQ ID NO: 596 - RNA, 25 nt, Artificial Sequence
  Description of Artificial Sequence: Synthetic oligonucleotide
cagugucaaguugugcuuguuuaca

SEQ ID NO: 597 - RNA, 25 nt, Artificial Sequence
  Description of Artificial Sequence: Synthetic oligonucleotide
agugucaaguugugcuuguuuacag

SEQ ID NO: 598 - RNA, 25 nt, Artificial Sequence
  Description of Artificial Sequence: Synthetic oligonucleotide
uuguuuacagcacuacucugugcca

SEQ ID NO: 599 - RNA, 25 nt, Artificial Sequence
  Description of Artificial Sequence: Synthetic oligonucleotide
uguuuacagcacuacucugugccag

SEQ ID NO: 600 - RNA, 25 nt, Artificial Sequence
  Description of Artificial Sequence: Synthetic oligonucleotide
caaacguuuacuuaucuuaugccac

SEQ ID NO: 601 - RNA, 25 nt, Artificial Sequence
  Description of Artificial Sequence: Synthetic oligonucleotide
cgggaaguuuagagagcuaagauua

SEQ ID NO: 602 - RNA, 25 nt, Artificial Sequence
  Description of Artificial Sequence: Synthetic oligonucleotide
gggaaguuuagagagcuaagauuau

SEQ ID NO: 603 - RNA, 25 nt, Artificial Sequence
  Description of Artificial Sequence: Synthetic oligonucleotide
ggaaguuuagagagcuaagauuauc

SEQ ID NO: 604 - RNA, 25 nt, Artificial Sequence
  Description of Artificial Sequence: Synthetic oligonucleotide
gaaguuuagagagcuaagauuaucu

SEQ ID NO: 605 - RNA, 25 nt, Artificial Sequence
  Description of Artificial Sequence: Synthetic oligonucleotide
aguuuagagagcuaagauuaucugg

SEQ ID NO: 606 - RNA, 25 nt, Artificial Sequence
  Description of Artificial Sequence: Synthetic oligonucleotide
agagagcuaagauuaucuggggaaa

SEQ ID NO: 607 - RNA, 25 nt, Artificial Sequence
  Description of Artificial Sequence: Synthetic oligonucleotide
gagagcuaagauuaucuggggaaau

SEQ ID NO: 608 - RNA, 25 nt, Artificial Sequence
  Description of Artificial Sequence: Synthetic oligonucleotide
agagcuaagauuaucuggggaaauc

SEQ ID NO: 609 - RNA, 25 nt, Artificial Sequence
  Description of Artificial Sequence: Synthetic oligonucleotide
agauuaucuggggaaaucaaaacaa

SEQ ID NO: 610 - RNA, 25 nt, Artificial Sequence
  Description of Artificial Sequence: Synthetic oligonucleotide
gauuaucuggggaaaucaaaacaaa

SEQ ID NO: 611 - RNA, 25 nt, Artificial Sequence
  Description of Artificial Sequence: Synthetic oligonucleotide
cuggggaaaucaaaacaaaaacaag

SEQ ID NO: 612 - RNA, 25 nt, Artificial Sequence
  Description of Artificial Sequence: Synthetic oligonucleotide
ggaaaucaaaacaaaaacaagcaaa

SEQ ID NO: 613 - DNA, 21 bp, Artificial Sequence
  Description of Artificial Sequence: Synthetic oligonucleotide
tgaagtttttaaaagctgcta

SEQ ID NO: 614 - DNA, 21 bp, Artificial Sequence
  Description of Artificial Sequence: Synthetic oligonucleotide
gaagtttttaaaagctgctaa

SEQ ID NO: 615 - DNA, 21 bp, Artificial Sequence
  Description of Artificial Sequence: Synthetic oligonucleotide
aagtttttaaaagctgctaaa

SEQ ID NO: 616 - DNA, 21 bp, Artificial Sequence
  Description of Artificial Sequence: Synthetic oligonucleotide
tgcggagccagagatcaaaag

SEQ ID NO: 617 - DNA, 21 bp, Artificial Sequence
  Description of Artificial Sequence: Synthetic oligonucleotide
gccagagatcaaaagatgaaa

SEQ ID NO: 618 - DNA, 21 bp, Artificial Sequence
  Description of Artificial Sequence: Synthetic oligonucleotide
ccagagatcaaaagatgaaaa

SEQ ID NO: 619 - DNA, 21 bp, Artificial Sequence
  Description of Artificial Sequence: Synthetic oligonucleotide
caaaagatgaaaaggcagtca

SEQ ID NO: 620 - DNA, 21 bp, Artificial Sequence
  Description of Artificial Sequence: Synthetic oligonucleotide
aaaagatgaaaaggcagtcag

SEQ ID NO: 621 - DNA, 21 bp, Artificial Sequence
  Description of Artificial Sequence: Synthetic oligonucleotide
gtcaggtcttcagtagccaaa

SEQ ID NO: 622 - DNA, 21 bp, Artificial Sequence
  Description of Artificial Sequence: Synthetic oligonucleotide
tcaggtcttcagtagccaaaa

SEQ ID NO: 623 - DNA, 21 bp, Artificial Sequence
  Description of Artificial Sequence: Synthetic oligonucleotide
cagtagccaaaaaacaaaaca

SEQ ID NO: 624 - DNA, 21 bp, Artificial Sequence
  Description of Artificial Sequence: Synthetic oligonucleotide
gccaaaaaacaaaacaaacaa

SEQ ID NO: 625 - DNA, 21 bp, Artificial Sequence
  Description of Artificial Sequence: Synthetic oligonucleotide
ccaaaaaacaaaacaaacaaa

SEQ ID NO: 626 - DNA, 21 bp, Artificial Sequence
  Description of Artificial Sequence: Synthetic oligonucleotide
acaaaacaaacaaaaacaaaa

SEQ ID NO: 627 - DNA, 21 bp, Artificial Sequence
  Description of Artificial Sequence: Synthetic oligonucleotide
aacaaaaacaaaaaagccgaa

SEQ ID NO: 628 - DNA, 21 bp, Artificial Sequence
  Description of Artificial Sequence: Synthetic oligonucleotide
acaaaaacaaaaaagccgaaa

SEQ ID NO: 629 - DNA, 21 bp, Artificial Sequence
  Description of Artificial Sequence: Synthetic oligonucleotide
caaaaacaaaaaagccgaaat

SEQ ID NO: 630 - DNA, 21 bp, Artificial Sequence
  Description of Artificial Sequence: Synthetic oligonucleotide
acaaaaaagccgaaataaaag

SEQ ID NO: 631 - DNA, 21 bp, Artificial Sequence
  Description of Artificial Sequence: Synthetic oligonucleotide
caaaaaagccgaaataaaaga

SEQ ID NO: 632 - DNA, 21 bp, Artificial Sequence
  Description of Artificial Sequence: Synthetic oligonucleotide
aaaaagccgaaataaaagaaa

SEQ ID NO: 633 - DNA, 21 bp, Artificial Sequence
  Description of Artificial Sequence: Synthetic oligonucleotide
gccgaaataaaagaaaaagat

SEQ ID NO: 634 - DNA, 21 bp, Artificial Sequence
  Description of Artificial Sequence: Synthetic oligonucleotide
ccgaaataaaagaaaaagata

SEQ ID NO: 635 - DNA, 21 bp, Artificial Sequence
  Description of Artificial Sequence: Synthetic oligonucleotide
cgaaataaaagaaaaagataa

SEQ ID NO: 636 - DNA, 21 bp, Artificial Sequence
  Description of Artificial Sequence: Synthetic oligonucleotide
aagaaaaagataataactcag

SEQ ID NO: 637 - DNA, 21 bp, Artificial Sequence
  Description of Artificial Sequence: Synthetic oligonucleotide
aaaagataataactcagttct

SEQ ID NO: 638 - DNA, 21 bp, Artificial Sequence
  Description of Artificial Sequence: Synthetic oligonucleotide
aaagataataactcagttctt

SEQ ID NO: 639 - DNA, 21 bp, Artificial Sequence
  Description of Artificial Sequence: Synthetic oligonucleotide
agataataactcagttcttat

SEQ ID NO: 640 - DNA, 21 bp, Artificial Sequence
  Description of Artificial Sequence: Synthetic oligonucleotide
gataataactcagttcttatt

SEQ ID NO: 641 - DNA, 21 bp, Artificial Sequence
  Description of Artificial Sequence: Synthetic oligonucleotide
tcttatttgcacctacttcag

SEQ ID NO: 642 - DNA, 21 bp, Artificial Sequence
  Description of Artificial Sequence: Synthetic oligonucleotide
tcagtggacactgaatttgga

SEQ ID NO: 643 - DNA, 21 bp, Artificial Sequence
  Description of Artificial Sequence: Synthetic oligonucleotide
cactgaatttggaaggtggag

SEQ ID NO: 644 - DNA, 21 bp, Artificial Sequence
  Description of Artificial Sequence: Synthetic oligonucleotide
tttggaaggtggaggattttg

SEQ ID NO: 645 - DNA, 21 bp, Artificial Sequence
  Description of Artificial Sequence: Synthetic oligonucleotide
ggaaggtggaggattttgttt

SEQ ID NO: 646 - DNA, 21 bp, Artificial Sequence
  Description of Artificial Sequence: Synthetic oligonucleotide
tggaggattttgtttttttct

SEQ ID NO: 647 - DNA, 21 bp, Artificial Sequence
  Description of Artificial Sequence: Synthetic oligonucleotide
ggaggattttgtttttttctt

SEQ ID NO: 648 - DNA, 21 bp, Artificial Sequence
  Description of Artificial Sequence: Synthetic oligonucleotide
aggattttgtttttttctttt

SEQ ID NO: 649 - DNA, 21 bp, Artificial Sequence
  Description of Artificial Sequence: Synthetic oligonucleotide
ggattttgtttttttctttta

SEQ ID NO: 650 - DNA, 21 bp, Artificial Sequence
  Description of Artificial Sequence: Synthetic oligonucleotide
gattttgtttttttcttttaa

SEQ ID NO: 651 - DNA, 21 bp, Artificial Sequence
  Description of Artificial Sequence: Synthetic oligonucleotide
attttgtttttttcttttaag

SEQ ID NO: 652 - DNA, 21 bp, Artificial Sequence
  Description of Artificial Sequence: Synthetic oligonucleotide
tgtttttttcttttaagatct

SEQ ID NO: 653 - DNA, 21 bp, Artificial Sequence
  Description of Artificial Sequence: Synthetic oligonucleotide
gtttttttcttttaagatctg

SEQ ID NO: 654 - DNA, 21 bp, Artificial Sequence
  Description of Artificial Sequence: Synthetic oligonucleotide
tttaagatctgggcatctttt

SEQ ID NO: 655 - DNA, 21 bp, Artificial Sequence
  Description of Artificial Sequence: Synthetic oligonucleotide
atcttttgaatctacccttca

SEQ ID NO: 656 - DNA, 21 bp, Artificial Sequence
  Description of Artificial Sequence: Synthetic oligonucleotide
tcttttgaatctacccttcaa

SEQ ID NO: 657 - DNA, 21 bp, Artificial Sequence
  Description of Artificial Sequence: Synthetic oligonucleotide
cttttgaatctacccttcaag

SEQ ID NO: 658 - DNA, 21 bp, Artificial Sequence
  Description of Artificial Sequence: Synthetic oligonucleotide
ttttgaatctacccttcaagt

SEQ ID NO: 659 - DNA, 21 bp, Artificial Sequence
  Description of Artificial Sequence: Synthetic oligonucleotide
tttgaatctacccttcaagta

SEQ ID NO: 660 - DNA, 21 bp, Artificial Sequence
  Description of Artificial Sequence: Synthetic oligonucleotide
tcaagtattaagagacagact

SEQ ID NO: 661 - DNA, 21 bp, Artificial Sequence
  Description of Artificial Sequence: Synthetic oligonucleotide
agtattaagagacagactgtg

SEQ ID NO: 662 - DNA, 21 bp, Artificial Sequence
  Description of Artificial Sequence: Synthetic oligonucleotide
ctgttgaactcttctgagcaa

SEQ ID NO: 663 - DNA, 21 bp, Artificial Sequence
  Description of Artificial Sequence: Synthetic oligonucleotide
tgttgaactcttctgagcaag

SEQ ID NO: 664 - DNA, 21 bp, Artificial Sequence
  Description of Artificial Sequence: Synthetic oligonucleotide
caaggatggaagtgcagttag

SEQ ID NO: 665 - DNA, 21 bp, Artificial Sequence
  Description of Artificial Sequence: Synthetic oligonucleotide
ccgaggagctttccagaatct

SEQ ID NO: 666 - DNA, 21 bp, Artificial Sequence
  Description of Artificial Sequence: Synthetic oligonucleotide
cgaggagctttccagaatctg

SEQ ID NO: 667 - DNA, 21 bp, Artificial Sequence
  Description of Artificial Sequence: Synthetic oligonucleotide
cgctgaccttaaagacatcct

SEQ ID NO: 668 - DNA, 21 bp, Artificial Sequence
  Description of Artificial Sequence: Synthetic oligonucleotide
tccaaggacaattacttaggg

SEQ ID NO: 669 - DNA, 21 bp, Artificial Sequence
  Description of Artificial Sequence: Synthetic oligonucleotide
ccaaggagttgtgtaaggcag

SEQ ID NO: 670 - DNA, 21 bp, Artificial Sequence
  Description of Artificial Sequence: Synthetic oligonucleotide
cactgaagatactgctgagta

SEQ ID NO: 671 - DNA, 21 bp, Artificial Sequence
  Description of Artificial Sequence: Synthetic oligonucleotide
tgctgagtattcccctttcaa

SEQ ID NO: 672 - DNA, 21 bp, Artificial Sequence
  Description of Artificial Sequence: Synthetic oligonucleotide
cacttgtgtcaaaagcgaaat

SEQ ID NO: 673 - DNA, 21 bp, Artificial Sequence
  Description of Artificial Sequence: Synthetic oligonucleotide
acttgtgtcaaaagcgaaatg

SEQ ID NO: 674 - DNA, 21 bp, Artificial Sequence
  Description of Artificial Sequence: Synthetic oligonucleotide
accatgttttgcccattgact

SEQ ID NO: 675 - DNA, 21 bp, Artificial Sequence
  Description of Artificial Sequence: Synthetic oligonucleotide
catgttttgcccattgactat

SEQ ID NO: 676 - DNA, 21 bp, Artificial Sequence
  Description of Artificial Sequence: Synthetic oligonucleotide
ctgtggagatgaagcttctgg

SEQ ID NO: 677 - DNA, 21 bp, Artificial Sequence
  Description of Artificial Sequence: Synthetic oligonucleotide
tgaagggaaacagaagtacct

SEQ ID NO: 678 - DNA, 21 bp, Artificial Sequence
  Description of Artificial Sequence: Synthetic oligonucleotide
gcagaaatgattgcactattg

SEQ ID NO: 679 - DNA, 21 bp, Artificial Sequence
  Description of Artificial Sequence: Synthetic oligonucleotide
cagaaatgattgcactattga

SEQ ID NO: 680 - DNA, 21 bp, Artificial Sequence
  Description of Artificial Sequence: Synthetic oligonucleotide
agaaatgattgcactattgat

SEQ ID NO: 681 - DNA, 21 bp, Artificial Sequence
  Description of Artificial Sequence: Synthetic oligonucleotide
aaatgattgcactattgataa

SEQ ID NO: 682 - DNA, 21 bp, Artificial Sequence
  Description of Artificial Sequence: Synthetic oligonucleotide
aatgattgcactattgataaa

SEQ ID NO: 683 - DNA, 21 bp, Artificial Sequence
  Description of Artificial Sequence: Synthetic oligonucleotide
cactattgataaattccgaag

SEQ ID NO: 684 - DNA, 21 bp, Artificial Sequence
  Description of Artificial Sequence: Synthetic oligonucleotide
actattgataaattccgaagg

SEQ ID NO: 685 - DNA, 21 bp, Artificial Sequence
  Description of Artificial Sequence: Synthetic oligonucleotide
ctattgataaattccgaagga

SEQ ID NO: 686 - DNA, 21 bp, Artificial Sequence
  Description of Artificial Sequence: Synthetic oligonucleotide
tattgataaattccgaaggaa

SEQ ID NO: 687 - DNA, 21 bp, Artificial Sequence
  Description of Artificial Sequence: Synthetic oligonucleotide
attgataaattccgaaggaaa

SEQ ID NO: 688 - DNA, 21 bp, Artificial Sequence
  Description of Artificial Sequence: Synthetic oligonucleotide
tgataaattccgaaggaaaaa

SEQ ID NO: 689 - DNA, 21 bp, Artificial Sequence
  Description of Artificial Sequence: Synthetic oligonucleotide
gataaattccgaaggaaaaat

SEQ ID NO: 690 - DNA, 21 bp, Artificial Sequence
  Description of Artificial Sequence: Synthetic oligonucleotide
cgaaggaaaaattgtccatct

SEQ ID NO: 691 - DNA, 21 bp, Artificial Sequence
  Description of Artificial Sequence: Synthetic oligonucleotide
atcttgtcgtcttcggaaatg

SEQ ID NO: 692 - DNA, 21 bp, Artificial Sequence
  Description of Artificial Sequence: Synthetic oligonucleotide
cggaaatgttatgaagcaggg

SEQ ID NO: 693 - DNA, 21 bp, Artificial Sequence
  Description of Artificial Sequence: Synthetic oligonucleotide
gaaatgttatgaagcagggat

SEQ ID NO: 694 - DNA, 21 bp, Artificial Sequence
  Description of Artificial Sequence: Synthetic oligonucleotide
cccggaagctgaagaaacttg

SEQ ID NO: 695 - DNA, 21 bp, Artificial Sequence
  Description of Artificial Sequence: Synthetic oligonucleotide
cggaagctgaagaaacttggt

SEQ ID NO: 696 - DNA, 21 bp, Artificial Sequence
  Description of Artificial Sequence: Synthetic oligonucleotide
gctgaagaaacttggtaatct

SEQ ID NO: 697 - DNA, 21 bp, Artificial Sequence
  Description of Artificial Sequence: Synthetic oligonucleotide
ctgaagaaacttggtaatctg

SEQ ID NO: 698 - DNA, 21 bp, Artificial Sequence
  Description of Artificial Sequence: Synthetic oligonucleotide
tgaagaaacttggtaatctga

SEQ ID NO: 699 - DNA, 21 bp, Artificial Sequence
  Description of Artificial Sequence: Synthetic oligonucleotide
ttggtaatctgaaactacagg

SEQ ID NO: 700 - DNA, 21 bp, Artificial Sequence
  Description of Artificial Sequence: Synthetic oligonucleotide
atctgaaactacaggaggaag

SEQ ID NO: 701 - DNA, 21 bp, Artificial Sequence
  Description of Artificial Sequence: Synthetic oligonucleotide
cccaggaattcctgtgcatga

SEQ ID NO: 702 - DNA, 21 bp, Artificial Sequence
  Description of Artificial Sequence: Synthetic oligonucleotide
ccaggaattcctgtgcatgaa

SEQ ID NO: 703 - DNA, 21 bp, Artificial Sequence
  Description of Artificial Sequence: Synthetic oligonucleotide
gtggatgggctgaaaaatcaa

SEQ ID NO: 704 - DNA, 21 bp, Artificial Sequence
  Description of Artificial Sequence: Synthetic oligonucleotide
tggatgggctgaaaaatcaaa

SEQ ID NO: 705 - DNA, 21 bp, Artificial Sequence
  Description of Artificial Sequence: Synthetic oligonucleotide
gatgggctgaaaaatcaaaaa

SEQ ID NO: 706 - DNA, 21 bp, Artificial Sequence
  Description of Artificial Sequence: Synthetic oligonucleotide
ggctgaaaaatcaaaaattct

SEQ ID NO: 707 - DNA, 21 bp, Artificial Sequence
  Description of Artificial Sequence: Synthetic oligonucleotide
gctgaaaaatcaaaaattctt

SEQ ID NO: 708 - DNA, 21 bp, Artificial Sequence
  Description of Artificial Sequence: Synthetic oligonucleotide
tgaaaaatcaaaaattctttg

SEQ ID NO: 709 - DNA, 21 bp, Artificial Sequence
  Description of Artificial Sequence: Synthetic oligonucleotide
gaaaaatcaaaaattctttga

SEQ ID NO: 710 - DNA, 21 bp, Artificial Sequence
  Description of Artificial Sequence: Synthetic oligonucleotide
aaaaatcaaaaattctttgat

SEQ ID NO: 711 - DNA, 21 bp, Artificial Sequence
  Description of Artificial Sequence: Synthetic oligonucleotide
ttcgaatgaactacatcaagg

SEQ ID NO: 712 - DNA, 21 bp, Artificial Sequence
  Description of Artificial Sequence: Synthetic oligonucleotide
tcaaggaactcgatcgtatca

SEQ ID NO: 713 - DNA, 21 bp, Artificial Sequence
  Description of Artificial Sequence: Synthetic oligonucleotide
caaggaactcgatcgtatcat

SEQ ID NO: 714 - DNA, 21 bp, Artificial Sequence
  Description of Artificial Sequence: Synthetic oligonucleotide
atcgtatcattgcatgcaaaa

SEQ ID NO: 715 - DNA, 21 bp, Artificial Sequence
  Description of Artificial Sequence: Synthetic oligonucleotide
tcgtatcattgcatgcaaaag

SEQ ID NO: 716 - DNA, 21 bp, Artificial Sequence
  Description of Artificial Sequence: Synthetic oligonucleotide
atcattgcatgcaaaagaaaa

SEQ ID NO: 717 - DNA, 21 bp, Artificial Sequence
  Description of Artificial Sequence: Synthetic oligonucleotide
cacttttgacctgctaatcaa

SEQ ID NO: 718 - DNA, 21 bp, Artificial Sequence
  Description of Artificial Sequence: Synthetic oligonucleotide
gcgtggactttccggaaatga

SEQ ID NO: 719 - DNA, 21 bp, Artificial Sequence
  Description of Artificial Sequence: Synthetic oligonucleotide
cgtggactttccggaaatgat

SEQ ID NO: 720 - DNA, 21 bp, Artificial Sequence
  Description of Artificial Sequence: Synthetic oligonucleotide
tgatggcagagatcatctctg

SEQ ID NO: 721 - DNA, 21 bp, Artificial Sequence
  Description of Artificial Sequence: Synthetic oligonucleotide
gcagagatcatctctgtgcaa

SEQ ID NO: 722 - DNA, 21 bp, Artificial Sequence
  Description of Artificial Sequence: Synthetic oligonucleotide
cagagatcatctctgtgcaag

SEQ ID NO: 723 - DNA, 21 bp, Artificial Sequence
  Description of Artificial Sequence: Synthetic oligonucleotide
cccaagatcctttctgggaaa

SEQ ID NO: 724 - DNA, 21 bp, Artificial Sequence
  Description of Artificial Sequence: Synthetic oligonucleotide
gtgaagcattggaaaccctat

SEQ ID NO: 725 - DNA, 21 bp, Artificial Sequence
  Description of Artificial Sequence: Synthetic oligonucleotide
cagatgtcttctgcctgttat

SEQ ID NO: 726 - DNA, 21 bp, Artificial Sequence
  Description of Artificial Sequence: Synthetic oligonucleotide
gccttggggaatttcctctat

SEQ ID NO: 727 - DNA, 21 bp, Artificial Sequence
  Description of Artificial Sequence: Synthetic oligonucleotide
cttggggaatttcctctattg

SEQ ID NO: 728 - DNA, 21 bp, Artificial Sequence
  Description of Artificial Sequence: Synthetic oligonucleotide
ttggggaatttcctctattga

SEQ ID NO: 729 - DNA, 21 bp, Artificial Sequence
  Description of Artificial Sequence: Synthetic oligonucleotide
tggggaatttcctctattgat

SEQ ID NO: 730 - DNA, 21 bp, Artificial Sequence
  Description of Artificial Sequence: Synthetic oligonucleotide
ggggaatttcctctattgatg

SEQ ID NO: 731 - DNA, 21 bp, Artificial Sequence
  Description of Artificial Sequence: Synthetic oligonucleotide
ctattgatgtacagtctgtca

SEQ ID NO: 732 - DNA, 21 bp, Artificial Sequence
  Description of Artificial Sequence: Synthetic oligonucleotide
tattgatgtacagtctgtcat

SEQ ID NO: 733 - DNA, 21 bp, Artificial Sequence
  Description of Artificial Sequence: Synthetic oligonucleotide
attgatgtacagtctgtcatg

SEQ ID NO: 734 - DNA, 21 bp, Artificial Sequence
  Description of Artificial Sequence: Synthetic oligonucleotide
aacatgttcctgaattctatt

SEQ ID NO: 735 - DNA, 21 bp, Artificial Sequence
  Description of Artificial Sequence: Synthetic oligonucleotide
ttctatttgctgggctttttt

SEQ ID NO: 736 - DNA, 21 bp, Artificial Sequence
  Description of Artificial Sequence: Synthetic oligonucleotide
tctatttgctgggcttttttt

SEQ ID NO: 737 - DNA, 21 bp, Artificial Sequence
  Description of Artificial Sequence: Synthetic oligonucleotide
tgctgggctttttttttctct

SEQ ID NO: 738 - DNA, 21 bp, Artificial Sequence
  Description of Artificial Sequence: Synthetic oligonucleotide
ttttttttctctttctctcct

SEQ ID NO: 739 - DNA, 21 bp, Artificial Sequence
  Description of Artificial Sequence: Synthetic oligonucleotide
ttcagactttgcttcccattg

SEQ ID NO: 740 - DNA, 21 bp, Artificial Sequence
  Description of Artificial Sequence: Synthetic oligonucleotide
ttgtggctcctatctgtgttt

SEQ ID NO: 741 - DNA, 21 bp, Artificial Sequence
  Description of Artificial Sequence: Synthetic oligonucleotide
tcctatctgtgttttgaatgg

SEQ ID NO: 742 - DNA, 21 bp, Artificial Sequence
  Description of Artificial Sequence: Synthetic oligonucleotide
atctgtgttttgaatggtgtt

SEQ ID NO: 743 - DNA, 21 bp, Artificial Sequence
  Description of Artificial Sequence: Synthetic oligonucleotide
tgtgttttgaatggtgttgta

SEQ ID NO: 744 - DNA, 21 bp, Artificial Sequence
  Description of Artificial Sequence: Synthetic oligonucleotide
tgaatggtgttgtatgccttt

SEQ ID NO: 745 - DNA, 21 bp, Artificial Sequence
  Description of Artificial Sequence: Synthetic oligonucleotide
gaatggtgttgtatgccttta

SEQ ID NO: 746 - DNA, 21 bp, Artificial Sequence
  Description of Artificial Sequence: Synthetic oligonucleotide
tgttgtatgcctttaaatctg

SEQ ID NO: 747 - DNA, 21 bp, Artificial Sequence
  Description of Artificial Sequence: Synthetic oligonucleotide
ttgtatgcctttaaatctgtg

SEQ ID NO: 748 - DNA, 21 bp, Artificial Sequence
  Description of Artificial Sequence: Synthetic oligonucleotide
tgtatgcctttaaatctgtga

SEQ ID NO: 749 - DNA, 21 bp, Artificial Sequence
  Description of Artificial Sequence: Synthetic oligonucleotide
cccagtgtcaagttgtgcttg

SEQ ID NO: 750 - DNA, 21 bp, Artificial Sequence
  Description of Artificial Sequence: Synthetic oligonucleotide
ccagtgtcaagttgtgcttgt

SEQ ID NO: 751 - DNA, 21 bp, Artificial Sequence
  Description of Artificial Sequence: Synthetic oligonucleotide
gcttgtttacagcactactct

SEQ ID NO: 752 - DNA, 21 bp, Artificial Sequence
  Description of Artificial Sequence: Synthetic oligonucleotide
cttgtttacagcactactctg

SEQ ID NO: 753 - DNA, 21 bp, Artificial Sequence
  Description of Artificial Sequence: Synthetic oligonucleotide
cacaaacgtttacttatctta

SEQ ID NO: 754 - DNA, 21 bp, Artificial Sequence
  Description of Artificial Sequence: Synthetic oligonucleotide
cacgggaagtttagagagcta

SEQ ID NO: 755 - DNA, 21 bp, Artificial Sequence
  Description of Artificial Sequence: Synthetic oligonucleotide
acgggaagtttagagagctaa

SEQ ID NO: 756 - DNA, 21 bp, Artificial Sequence
  Description of Artificial Sequence: Synthetic oligonucleotide
cgggaagtttagagagctaag

SEQ ID NO: 757 - DNA, 21 bp, Artificial Sequence
  Description of Artificial Sequence: Synthetic oligonucleotide
gggaagtttagagagctaaga

SEQ ID NO: 758 - DNA, 21 bp, Artificial Sequence
  Description of Artificial Sequence: Synthetic oligonucleotide
gaagtttagagagctaagatt

SEQ ID NO: 759 - DNA, 21 bp, Artificial Sequence
  Description of Artificial Sequence: Synthetic oligonucleotide
ttagagagctaagattatctg

SEQ ID NO: 760 - DNA, 21 bp, Artificial Sequence
  Description of Artificial Sequence: Synthetic oligonucleotide
tagagagctaagattatctgg

SEQ ID NO: 761 - DNA, 21 bp, Artificial Sequence
  Description of Artificial Sequence: Synthetic oligonucleotide
agagagctaagattatctggg

SEQ ID NO: 762 - DNA, 21 bp, Artificial Sequence
  Description of Artificial Sequence: Synthetic oligonucleotide
taagattatctggggaaatca

SEQ ID NO: 763 - DNA, 21 bp, Artificial Sequence
  Description of Artificial Sequence: Synthetic oligonucleotide
aagattatctggggaaatcaa

SEQ ID NO: 764 - DNA, 21 bp, Artificial Sequence
  Description of Artificial Sequence: Synthetic oligonucleotide
atctggggaaatcaaaacaaa

SEQ ID NO: 765 - DNA, 21 bp, Artificial Sequence
  Description of Artificial Sequence: Synthetic oligonucleotide
ggggaaatcaaaacaaaaaca

SEQ ID NO: 766 - DNA, 25 bp, Artificial Sequence
  Description of Artificial Sequence: Synthetic oligonucleotide
  Description of Combined DNA/RNA Molecule: Synthetic oligonucleotide
gaaguuuuuaaaagcugcuaaagac

SEQ ID NO: 767 - DNA, 25 bp, Artificial Sequence
  Description of Artificial Sequence: Synthetic oligonucleotide
  Description of Combined DNA/RNA Molecule: Synthetic oligonucleotide
cuagcugcacauugcaaagaaggct

SEQ ID NO: 768 - DNA, 25 bp, Artificial Sequence
  Description of Artificial Sequence: Synthetic oligonucleotide
  Description of Combined DNA/RNA Molecule: Synthetic oligonucleotide
auugcaaagaaggcucuuaggagcc

SEQ ID NO: 769 - DNA, 25 bp, Artificial Sequence
  Description of Artificial Sequence: Synthetic oligonucleotide
  Description of Combined DNA/RNA Molecule: Synthetic oligonucleotide
caaaacaaacaaaaacaaaaaagcc

SEQ ID NO: 770 - DNA, 25 bp, Artificial Sequence
  Description of Artificial Sequence: Synthetic oligonucleotide
  Description of Combined DNA/RNA Molecule: Synthetic oligonucleotide
gauaauaacucaguucuuauuugca

SEQ ID NO: 771 - DNA, 25 bp, Artificial Sequence
  Description of Artificial Sequence: Synthetic oligonucleotide
  Description of Combined DNA/RNA Molecule: Synthetic oligonucleotide
caguggacacugaauuuggaaggtg

SEQ ID NO: 772 - DNA, 25 bp, Artificial Sequence
  Description of Artificial Sequence: Synthetic oligonucleotide
  Description of Combined DNA/RNA Molecule: Synthetic oligonucleotide
guggacacugaauuuggaaggugga

SEQ ID NO: 773 - DNA, 25 bp, Artificial Sequence
  Description of Artificial Sequence: Synthetic oligonucleotide
  Description of Combined DNA/RNA Molecule: Synthetic oligonucleotide
uggacacugaauuuggaagguggag

SEQ ID NO: 774 - DNA, 25 bp, Artificial Sequence
  Description of Artificial Sequence: Synthetic oligonucleotide
  Description of Combined DNA/RNA Molecule: Synthetic oligonucleotide
gaaucuacccuucaaguauuaagag

SEQ ID NO: 775 - DNA, 25 bp, Artificial Sequence
  Description of Artificial Sequence: Synthetic oligonucleotide
  Description of Combined DNA/RNA Molecule: Synthetic oligonucleotide
aguauuaagagacagacugugagcc

SEQ ID NO: 776 - DNA, 25 bp, Artificial Sequence
  Description of Artificial Sequence: Synthetic oligonucleotide
  Description of Combined DNA/RNA Molecule: Synthetic oligonucleotide
ugaguauuccccuuucaagggaggt

SEQ ID NO: 777 - DNA, 25 bp, Artificial Sequence
  Description of Artificial Sequence: Synthetic oligonucleotide
  Description of Combined DNA/RNA Molecule: Synthetic oligonucleotide
gaguauuccccuuucaagggaggtt

SEQ ID NO: 778 - DNA, 25 bp, Artificial Sequence
  Description of Artificial Sequence: Synthetic oligonucleotide
  Description of Combined DNA/RNA Molecule: Synthetic oligonucleotide
uguggagaugaagcuucugggugtc

SEQ ID NO: 779 - DNA, 25 bp, Artificial Sequence
  Description of Artificial Sequence: Synthetic oligonucleotide
  Description of Combined DNA/RNA Molecule: Synthetic oligonucleotide
agggaaacagaaguaccugugcgcc

SEQ ID NO: 780 - DNA, 25 bp, Artificial Sequence
  Description of Artificial Sequence: Synthetic oligonucleotide
  Description of Combined DNA/RNA Molecule: Synthetic oligonucleotide
gauaaauuccgaaggaaaaauugtc

SEQ ID NO: 781 - DNA, 25 bp, Artificial Sequence
  Description of Artificial Sequence: Synthetic oligonucleotide
  Description of Combined DNA/RNA Molecule: Synthetic oligonucleotide
aggaaaaauuguccaucuugucgtc

SEQ ID NO: 782 - DNA, 25 bp, Artificial Sequence
  Description of Artificial Sequence: Synthetic oligonucleotide
  Description of Combined DNA/RNA Molecule: Synthetic oligonucleotide
ggaaauguuaugaagcagggaugac

SEQ ID NO: 783 - DNA, 25 bp, Artificial Sequence
  Description of Artificial Sequence: Synthetic oligonucleotide
  Description of Combined DNA/RNA Molecule: Synthetic oligonucleotide
uugguaaucugaaacuacaggagga

SEQ ID NO: 784 - DNA, 25 bp, Artificial Sequence
  Description of Artificial Sequence: Synthetic oligonucleotide
  Description of Combined DNA/RNA Molecule: Synthetic oligonucleotide
ugguaaucugaaacuacaggaggaa

SEQ ID NO: 785 - DNA, 25 bp, Artificial Sequence
  Description of Artificial Sequence: Synthetic oligonucleotide
  Description of Combined DNA/RNA Molecule: Synthetic oligonucleotide
uaaucugaaacuacaggaggaagga

SEQ ID NO: 786 - DNA, 25 bp, Artificial Sequence
  Description of Artificial Sequence: Synthetic oligonucleotide
  Description of Combined DNA/RNA Molecule: Synthetic oligonucleotide
cugacagugucacacauugaaggct

SEQ ID NO: 787 - DNA, 25 bp, Artificial Sequence
  Description of Artificial Sequence: Synthetic oligonucleotide
  Description of Combined DNA/RNA Molecule: Synthetic oligonucleotide
cugucauucaguacuccuggauggg

SEQ ID NO: 788 - DNA, 25 bp, Artificial Sequence
  Description of Artificial Sequence: Synthetic oligonucleotide
  Description of Combined DNA/RNA Molecule: Synthetic oligonucleotide
gaaaaaucaaaaauucuuugaugaa

SEQ ID NO: 789 - DNA, 25 bp, Artificial Sequence
  Description of Artificial Sequence: Synthetic oligonucleotide
  Description of Combined DNA/RNA Molecule: Synthetic oligonucleotide
aauucuuugaugaacuucgaaugaa

SEQ ID NO: 790 - DNA, 25 bp, Artificial Sequence
  Description of Artificial Sequence: Synthetic oligonucleotide
  Description of Combined DNA/RNA Molecule: Synthetic oligonucleotide
cuaaucaagucacacauggugagcg

SEQ ID NO: 791 - DNA, 25 bp, Artificial Sequence
  Description of Artificial Sequence: Synthetic oligonucleotide
  Description of Combined DNA/RNA Molecule: Synthetic oligonucleotide
cguggacuuuccggaaaugauggca

SEQ ID NO: 792 - DNA, 25 bp, Artificial Sequence
  Description of Artificial Sequence: Synthetic oligonucleotide
  Description of Combined DNA/RNA Molecule: Synthetic oligonucleotide
uuggggaauuuccucuauugaugta

SEQ ID NO: 793 - DNA, 25 bp, Artificial Sequence
  Description of Artificial Sequence: Synthetic oligonucleotide
  Description of Combined DNA/RNA Molecule: Synthetic oligonucleotide
uguguuuugaaugguguuguaugcc

SEQ ID NO: 794 - DNA, 25 bp, Artificial Sequence
  Description of Artificial Sequence: Synthetic oligonucleotide
  Description of Combined DNA/RNA Molecule: Synthetic oligonucleotide
uguaugccuuuaaaucugugaugat

SEQ ID NO: 795 - DNA, 25 bp, Artificial Sequence
  Description of Artificial Sequence: Synthetic oligonucleotide
  Description of Combined DNA/RNA Molecule: Synthetic oligonucleotide
uagagagcuaagauuaucuggggaa

SEQ ID NO: 796 - RNA, 27 nt, Artificial Sequence
  Description of Artificial Sequence: Synthetic oligonucleotide
gucuuuagcagcuuuuaaaaacuucac

SEQ ID NO: 797 - RNA, 27 nt, Artificial Sequence
  Description of Artificial Sequence: Synthetic oligonucleotide
agccuucuuugcaaugugcagcuagcu

SEQ ID NO: 798 - RNA, 27 nt, Artificial Sequence
  Description of Artificial Sequence: Synthetic oligonucleotide
ggcuccuaagagccuucuuugcaaugu

SEQ ID NO: 799 - RNA, 27 nt, Artificial Sequence
  Description of Artificial Sequence: Synthetic oligonucleotide
ggcuuuuuuguuuuuguuuguuuuguu

SEQ ID NO: 800 - RNA, 27 nt, Artificial Sequence
  Description of Artificial Sequence: Synthetic oligonucleotide
ugcaaauaagaacugaguuauuaucuu

SEQ ID NO: 801 - RNA, 27 nt, Artificial Sequence
  Description of Artificial Sequence: Synthetic oligonucleotide
caccuuccaaauucaguguccacugaa

SEQ ID NO: 802 - RNA, 27 nt, Artificial Sequence
  Description of Artificial Sequence: Synthetic oligonucleotide
uccaccuuccaaauucaguguccacug

SEQ ID NO: 803 - RNA, 27 nt, Artificial Sequence
  Description of Artificial Sequence: Synthetic oligonucleotide
cuccaccuuccaaauucaguguccacu

SEQ ID NO: 804 - RNA, 27 nt, Artificial Sequence
  Description of Artificial Sequence: Synthetic oligonucleotide
cucuuaauacuugaaggguagauucaa

SEQ ID NO: 805 - RNA, 27 nt, Artificial Sequence
  Description of Artificial Sequence: Synthetic oligonucleotide
ggcucacagucugucucuuaauacuug

SEQ ID NO: 806 - RNA, 27 nt, Artificial Sequence
  Description of Artificial Sequence: Synthetic oligonucleotide
accucccuugaaaggggaauacucagc

SEQ ID NO: 807 - RNA, 27 nt, Artificial Sequence
  Description of Artificial Sequence: Synthetic oligonucleotide
aaccucccuugaaaggggaauacucag

SEQ ID NO: 808 - RNA, 27 nt, Artificial Sequence
  Description of Artificial Sequence: Synthetic oligonucleotide
gacacccagaagcuucaucuccacaga

SEQ ID NO: 809 - RNA, 27 nt, Artificial Sequence
  Description of Artificial Sequence: Synthetic oligonucleotide
ggcgcacagguacuucuguuucccuuc

SEQ ID NO: 810 - RNA, 27 nt, Artificial Sequence
  Description of Artificial Sequence: Synthetic oligonucleotide
gacaauuuuuccuucggaauuuaucaa

SEQ ID NO: 811 - RNA, 27 nt, Artificial Sequence
  Description of Artificial Sequence: Synthetic oligonucleotide
gacgacaagauggacaauuuuuccuuc

SEQ ID NO: 812 - RNA, 27 nt, Artificial Sequence
  Description of Artificial Sequence: Synthetic oligonucleotide
gucaucccugcuucauaacauuuccga

SEQ ID NO: 813 - RNA, 27 nt, Artificial Sequence
  Description of Artificial Sequence: Synthetic oligonucleotide
uccuccuguaguuucagauuaccaagu

SEQ ID NO: 814 - RNA, 27 nt, Artificial Sequence
  Description of Artificial Sequence: Synthetic oligonucleotide
uuccuccuguaguuucagauuaccaag

SEQ ID NO: 815 - RNA, 27 nt, Artificial Sequence
  Description of Artificial Sequence: Synthetic oligonucleotide
uccuuccuccuguaguuucagauuacc

SEQ ID NO: 816 - RNA, 27 nt, Artificial Sequence
  Description of Artificial Sequence: Synthetic oligonucleotide
agccuucaaugugugacacugucagcu

SEQ ID NO: 817 - RNA, 27 nt, Artificial Sequence
  Description of Artificial Sequence: Synthetic oligonucleotide
cccauccaggaguacugaaugacagcc

SEQ ID NO: 818 - RNA, 27 nt, Artificial Sequence
  Description of Artificial Sequence: Synthetic oligonucleotide
uucaucaaagaauuuuugauuuuucag

SEQ ID NO: 819 - RNA, 27 nt, Artificial Sequence
  Description of Artificial Sequence: Synthetic oligonucleotide
uucauucgaaguucaucaaagaauuuu

SEQ ID NO: 820 - RNA, 27 nt, Artificial Sequence
  Description of Artificial Sequence: Synthetic oligonucleotide
cgcucaccaugugugacuugauuagca

SEQ ID NO: 821 - RNA, 27 nt, Artificial Sequence
  Description of Artificial Sequence: Synthetic oligonucleotide
ugccaucauuuccggaaaguccacgcu

SEQ ID NO: 822 - RNA, 27 nt, Artificial Sequence
  Description of Artificial Sequence: Synthetic oligonucleotide
uacaucaauagaggaaauuccccaagg

SEQ ID NO: 823 - RNA, 27 nt, Artificial Sequence
  Description of Artificial Sequence: Synthetic oligonucleotide
ggcauacaacaccauucaaaacacaga

SEQ ID NO: 824 - RNA, 27 nt, Artificial Sequence
  Description of Artificial Sequence: Synthetic oligonucleotide
aucaucacagauuuaaaggcauacaac

SEQ ID NO: 825 - RNA, 27 nt, Artificial Sequence
  Description of Artificial Sequence: Synthetic oligonucleotide
uuccccagauaaucuuagcucucuaaa

SEQ ID NO: 826 - DNA, 27 bp, Artificial Sequence
  Description of Artificial Sequence: Synthetic oligonucleotide
gtgaagtttttaaaagctgctaaagac

SEQ ID NO: 827 - DNA, 27 bp, Artificial Sequence
  Description of Artificial Sequence: Synthetic oligonucleotide
agctagctgcacattgcaaagaaggct

SEQ ID NO: 828 - DNA, 27 bp, Artificial Sequence
  Description of Artificial Sequence: Synthetic oligonucleotide
acattgcaaagaaggctcttaggagcc

SEQ ID NO: 829 - DNA, 27 bp, Artificial Sequence
  Description of Artificial Sequence: Synthetic oligonucleotide
aacaaaacaaacaaaaacaaaaaagcc

SEQ ID NO: 830 - DNA, 27 bp, Artificial Sequence
  Description of Artificial Sequence: Synthetic oligonucleotide
aagataataactcagttcttatttgca

SEQ ID NO: 831 - DNA, 27 bp, Artificial Sequence
  Description of Artificial Sequence: Synthetic oligonucleotide
ttcagtggacactgaatttggaaggtg

SEQ ID NO: 832 - DNA, 27 bp, Artificial Sequence
  Description of Artificial Sequence: Synthetic oligonucleotide
cagtggacactgaatttggaaggtgga

SEQ ID NO: 833 - DNA, 27 bp, Artificial Sequence
  Description of Artificial Sequence: Synthetic oligonucleotide
agtggacactgaatttggaaggtggag

SEQ ID NO: 834 - DNA, 27 bp, Artificial Sequence
  Description of Artificial Sequence: Synthetic oligonucleotide
ttgaatctacccttcaagtattaagag

SEQ ID NO: 835 - DNA, 27 bp, Artificial Sequence
  Description of Artificial Sequence: Synthetic oligonucleotide
caagtattaagagacagactgtgagcc

SEQ ID NO: 836 - DNA, 27 bp, Artificial Sequence
  Description of Artificial Sequence: Synthetic oligonucleotide
gctgagtattcccctttcaagggaggt

SEQ ID NO: 837 - DNA, 27 bp, Artificial Sequence
  Description of Artificial Sequence: Synthetic oligonucleotide
ctgagtattcccctttcaagggaggtt

SEQ ID NO: 838 - DNA, 27 bp, Artificial Sequence
  Description of Artificial Sequence: Synthetic oligonucleotide
tctgtggagatgaagcttctgggtgtc

SEQ ID NO: 839 - DNA, 27 bp, Artificial Sequence
  Description of Artificial Sequence: Synthetic oligonucleotide
gaagggaaacagaagtacctgtgcgcc

SEQ ID NO: 840 - DNA, 27 bp, Artificial Sequence
  Description of Artificial Sequence: Synthetic oligonucleotide
ttgataaattccgaaggaaaaattgtc

SEQ ID NO: 841 - DNA, 27 bp, Artificial Sequence
  Description of Artificial Sequence: Synthetic oligonucleotide
gaaggaaaaattgtccatcttgtcgtc

SEQ ID NO: 842 - DNA, 27 bp, Artificial Sequence
  Description of Artificial Sequence: Synthetic oligonucleotide
tcggaaatgttatgaagcagggatgac

SEQ ID NO: 843 - DNA, 27 bp, Artificial Sequence
  Description of Artificial Sequence: Synthetic oligonucleotide
acttggtaatctgaaactacaggagga

SEQ ID NO: 844 - DNA, 27 bp, Artificial Sequence
  Description of Artificial Sequence: Synthetic oligonucleotide
cttggtaatctgaaactacaggaggaa

SEQ ID NO: 845 - DNA, 27 bp, Artificial Sequence
  Description of Artificial Sequence: Synthetic oligonucleotide
ggtaatctgaaactacaggaggaagga

SEQ ID NO: 846 - DNA, 27 bp, Artificial Sequence
  Description of Artificial Sequence: Synthetic oligonucleotide
agctgacagtgtcacacattgaaggct

SEQ ID NO: 847 - DNA, 27 bp, Artificial Sequence
  Description of Artificial Sequence: Synthetic oligonucleotide
ggctgtcattcagtactcctggatggg

SEQ ID NO: 848 - DNA, 27 bp, Artificial Sequence
  Description of Artificial Sequence: Synthetic oligonucleotide
ctgaaaaatcaaaaattctttgatgaa

SEQ ID NO: 849 - DNA, 27 bp, Artificial Sequence
  Description of Artificial Sequence: Synthetic oligonucleotide
aaaattctttgatgaacttcgaatgaa

SEQ ID NO: 850 - DNA, 27 bp, Artificial Sequence
  Description of Artificial Sequence: Synthetic oligonucleotide
tgctaatcaagtcacacatggtgagcg

SEQ ID NO: 851 - DNA, 27 bp, Artificial Sequence
  Description of Artificial Sequence: Synthetic oligonucleotide
agcgtggactttccggaaatgatggca

SEQ ID NO: 852 - DNA, 27 bp, Artificial Sequence
  Description of Artificial Sequence: Synthetic oligonucleotide
ccttggggaatttcctctattgatgta

SEQ ID NO: 853 - DNA, 27 bp, Artificial Sequence
  Description of Artificial Sequence: Synthetic oligonucleotide
tctgtgttttgaatggtgttgtatgcc

SEQ ID NO: 854 - DNA, 27 bp, Artificial Sequence
  Description of Artificial Sequence: Synthetic oligonucleotide
gttgtatgcctttaaatctgtgatgat

SEQ ID NO: 855 - DNA, 27 bp, Artificial Sequence
  Description of Artificial Sequence: Synthetic oligonucleotide
tttagagagctaagattatctggggaa

SEQ ID NO: 856 - RNA, 25 nt, Artificial Sequence
  Description of Artificial Sequence: Synthetic oligonucleotide
gaaguuuuuaaaagcugcuaaagac

SEQ ID NO: 857 - RNA, 25 nt, Artificial Sequence
  Description of Artificial Sequence: Synthetic oligonucleotide
cuagcugcacauugcaaagaaggcu

SEQ ID NO: 858 - RNA, 25 nt, Artificial Sequence
  Description of Artificial Sequence: Synthetic oligonucleotide
auugcaaagaaggcucuuaggagcc

SEQ ID NO: 859 - RNA, 25 nt, Artificial Sequence
  Description of Artificial Sequence: Synthetic oligonucleotide
caaaacaaacaaaaacaaaaaagcc

SEQ ID NO: 860 - RNA, 25 nt, Artificial Sequence
  Description of Artificial Sequence: Synthetic oligonucleotide
gauaauaacucaguucuuauuugca

SEQ ID NO: 861 - RNA, 25 nt, Artificial Sequence
  Description of Artificial Sequence: Synthetic oligonucleotide
caguggacacugaauuuggaaggug

SEQ ID NO: 862 - RNA, 25 nt, Artificial Sequence
  Description of Artificial Sequence: Synthetic oligonucleotide
guggacacugaauuuggaaggugga

SEQ ID NO: 863 - RNA, 25 nt, Artificial Sequence
  Description of Artificial Sequence: Synthetic oligonucleotide
uggacacugaauuuggaagguggag

SEQ ID NO: 864 - RNA, 25 nt, Artificial Sequence
  Description of Artificial Sequence: Synthetic oligonucleotide
gaaucuacccuucaaguauuaagag

SEQ ID NO: 865 - RNA, 25 nt, Artificial Sequence
  Description of Artificial Sequence: Synthetic oligonucleotide
aguauuaagagacagacugugagcc

SEQ ID NO: 866 - RNA, 25 nt, Artificial Sequence
  Description of Artificial Sequence: Synthetic oligonucleotide
ugaguauuccccuuucaagggaggu

SEQ ID NO: 867 - RNA, 25 nt, Artificial Sequence
  Description of Artificial Sequence: Synthetic oligonucleotide
gaguauuccccuuucaagggagguu

SEQ ID NO: 868 - RNA, 25 nt, Artificial Sequence
  Description of Artificial Sequence: Synthetic oligonucleotide
uguggagaugaagcuucuggguguc

SEQ ID NO: 869 - RNA, 25 nt, Artificial Sequence
  Description of Artificial Sequence: Synthetic oligonucleotide
agggaaacagaaguaccugugcgcc

SEQ ID NO: 870 - RNA, 25 nt, Artificial Sequence
  Description of Artificial Sequence: Synthetic oligonucleotide
gauaaauuccgaaggaaaaauuguc

SEQ ID NO: 871 - RNA, 25 nt, Artificial Sequence
  Description of Artificial Sequence: Synthetic oligonucleotide
aggaaaaauuguccaucuugucguc

SEQ ID NO: 872 - RNA, 25 nt, Artificial Sequence
  Description of Artificial Sequence: Synthetic oligonucleotide
ggaaauguuaugaagcagggaugac

SEQ ID NO: 873 - RNA, 25 nt, Artificial Sequence
  Description of Artificial Sequence: Synthetic oligonucleotide
uugguaaucugaaacuacaggagga

SEQ ID NO: 874 - RNA, 25 nt, Artificial Sequence
  Description of Artificial Sequence: Synthetic oligonucleotide
ugguaaucugaaacuacaggaggaa

SEQ ID NO: 875 - RNA, 25 nt, Artificial Sequence
  Description of Artificial Sequence: Synthetic oligonucleotide
uaaucugaaacuacaggaggaagga

SEQ ID NO: 876 - RNA, 25 nt, Artificial Sequence
  Description of Artificial Sequence: Synthetic oligonucleotide
cugacagugucacacauugaaggcu

SEQ ID NO: 877 - RNA, 25 nt, Artificial Sequence
  Description of Artificial Sequence: Synthetic oligonucleotide
cugucauucaguacuccuggauggg

SEQ ID NO: 878 - RNA, 25 nt, Artificial Sequence
  Description of Artificial Sequence: Synthetic oligonucleotide
gaaaaaucaaaaauucuuugaugaa

SEQ ID NO: 879 - RNA, 25 nt, Artificial Sequence
  Description of Artificial Sequence: Synthetic oligonucleotide
aauucuuugaugaacuucgaaugaa

SEQ ID NO: 880 - RNA, 25 nt, Artificial Sequence
  Description of Artificial Sequence: Synthetic oligonucleotide
cuaaucaagucacacauggugagcg

SEQ ID NO: 881 - RNA, 25 nt, Artificial Sequence
  Description of Artificial Sequence: Synthetic oligonucleotide
cguggacuuuccggaaaugauggca

SEQ ID NO: 882 - RNA, 25 nt, Artificial Sequence
  Description of Artificial Sequence: Synthetic oligonucleotide
uuggggaauuuccucuauugaugua

SEQ ID NO: 883 - RNA, 25 nt, Artificial Sequence
  Description of Artificial Sequence: Synthetic oligonucleotide
uguguuuugaaugguguuguaugcc

SEQ ID NO: 884 - RNA, 25 nt, Artificial Sequence
  Description of Artificial Sequence: Synthetic oligonucleotide
uguaugccuuuaaaucugugaugau

SEQ ID NO: 885 - RNA, 25 nt, Artificial Sequence
  Description of Artificial Sequence: Synthetic oligonucleotide
uagagagcuaagauuaucuggggaa

SEQ ID NO: 886 - DNA, 21 bp, Artificial Sequence
  Description of Artificial Sequence: Synthetic oligonucleotide
gtgaagtttttaaaagctgct

SEQ ID NO: 887 - DNA, 21 bp, Artificial Sequence
  Description of Artificial Sequence: Synthetic oligonucleotide
agctagctgcacattgcaaag

SEQ ID NO: 888 - DNA, 21 bp, Artificial Sequence
  Description of Artificial Sequence: Synthetic oligonucleotide
acattgcaaagaaggctctta

SEQ ID NO: 889 - DNA, 21 bp, Artificial Sequence
  Description of Artificial Sequence: Synthetic oligonucleotide
aacaaaacaaacaaaaacaaa

SEQ ID NO: 890 - DNA, 21 bp, Artificial Sequence
  Description of Artificial Sequence: Synthetic oligonucleotide
aagataataactcagttctta

SEQ ID NO: 891 - DNA, 21 bp, Artificial Sequence
  Description of Artificial Sequence: Synthetic oligonucleotide
ttcagtggacactgaatttgg

SEQ ID NO: 892 - DNA, 21 bp, Artificial Sequence
  Description of Artificial Sequence: Synthetic oligonucleotide
cagtggacactgaatttggaa

SEQ ID NO: 893 - DNA, 21 bp, Artificial Sequence
  Description of Artificial Sequence: Synthetic oligonucleotide
agtggacactgaatttggaag

SEQ ID NO: 894 - DNA, 21 bp, Artificial Sequence
  Description of Artificial Sequence: Synthetic oligonucleotide
ttgaatctacccttcaagtat

SEQ ID NO: 895 - DNA, 21 bp, Artificial Sequence
  Description of Artificial Sequence: Synthetic oligonucleotide
caagtattaagagacagactg

SEQ ID NO: 896 - DNA, 21 bp, Artificial Sequence
  Description of Artificial Sequence: Synthetic oligonucleotide
gctgagtattcccctttcaag

SEQ ID NO: 897 - DNA, 21 bp, Artificial Sequence
  Description of Artificial Sequence: Synthetic oligonucleotide
ctgagtattcccctttcaagg

SEQ ID NO: 898 - DNA, 21 bp, Artificial Sequence
  Description of Artificial Sequence: Synthetic oligonucleotide
tctgtggagatgaagcttctg

SEQ ID NO: 899 - DNA, 21 bp, Artificial Sequence
  Description of Artificial Sequence: Synthetic oligonucleotide
gaagggaaacagaagtacctg

SEQ ID NO: 900 - DNA, 21 bp, Artificial Sequence
  Description of Artificial Sequence: Synthetic oligonucleotide
ttgataaattccgaaggaaaa

SEQ ID NO: 901 - DNA, 21 bp, Artificial Sequence
  Description of Artificial Sequence: Synthetic oligonucleotide
gaaggaaaaattgtccatctt

SEQ ID NO: 902 - DNA, 21 bp, Artificial Sequence
  Description of Artificial Sequence: Synthetic oligonucleotide
tcggaaatgttatgaagcagg

SEQ ID NO: 903 - DNA, 21 bp, Artificial Sequence
  Description of Artificial Sequence: Synthetic oligonucleotide
acttggtaatctgaaactaca

SEQ ID NO: 904 - DNA, 21 bp, Artificial Sequence
  Description of Artificial Sequence: Synthetic oligonucleotide
cttggtaatctgaaactacag

SEQ ID NO: 905 - DNA, 21 bp, Artificial Sequence
  Description of Artificial Sequence: Synthetic oligonucleotide
ggtaatctgaaactacaggag

SEQ ID NO: 906 - DNA, 21 bp, Artificial Sequence
  Description of Artificial Sequence: Synthetic oligonucleotide
agctgacagtgtcacacattg

SEQ ID NO: 907 - DNA, 21 bp, Artificial Sequence
  Description of Artificial Sequence: Synthetic oligonucleotide
ggctgtcattcagtactcctg

SEQ ID NO: 908 - DNA, 21 bp, Artificial Sequence
  Description of Artificial Sequence: Synthetic oligonucleotide
ctgaaaaatcaaaaattcttt

SEQ ID NO: 909 - DNA, 21 bp, Artificial Sequence
  Description of Artificial Sequence: Synthetic oligonucleotide
aaaattctttgatgaacttcg

SEQ ID NO: 910 - DNA, 21 bp, Artificial Sequence
  Description of Artificial Sequence: Synthetic oligonucleotide
tgctaatcaagtcacacatgg

SEQ ID NO: 911 - DNA, 21 bp, Artificial Sequence
  Description of Artificial Sequence: Synthetic oligonucleotide
agcgtggactttccggaaatg

SEQ ID NO: 912 - DNA, 21 bp, Artificial Sequence
  Description of Artificial Sequence: Synthetic oligonucleotide
ccttggggaatttcctctatt

SEQ ID NO: 913 - DNA, 21 bp, Artificial Sequence
  Description of Artificial Sequence: Synthetic oligonucleotide
tctgtgttttgaatggtgttg

SEQ ID NO: 914 - DNA, 21 bp, Artificial Sequence
  Description of Artificial Sequence: Synthetic oligonucleotide
gttgtatgcctttaaatctgt

SEQ ID NO: 915 - DNA, 21 bp, Artificial Sequence
  Description of Artificial Sequence: Synthetic oligonucleotide
tttagagagctaagattatct

SEQ ID NO: 916 - DNA, 25 bp, Artificial Sequence
  Description of Artificial Sequence: Synthetic oligonucleotide
  Description of Combined DNA/RNA Molecule: Synthetic oligonucleotide
ggugaaguuuuuaaaagcugcuaaa

SEQ ID NO: 917 - DNA, 25 bp, Artificial Sequence
  Description of Artificial Sequence: Synthetic oligonucleotide
  Description of Combined DNA/RNA Molecule: Synthetic oligonucleotide
uuuuuaaaagcugcuaaagacucgg

SEQ ID NO: 918 - DNA, 25 bp, Artificial Sequence
  Description of Artificial Sequence: Synthetic oligonucleotide
  Description of Combined DNA/RNA Molecule: Synthetic oligonucleotide
agagagguaacucccuuuggcugcg

SEQ ID NO: 919 - DNA, 25 bp, Artificial Sequence
  Description of Artificial Sequence: Synthetic oligonucleotide
  Description of Combined DNA/RNA Molecule: Synthetic oligonucleotide
gagaucaaaagaugaaaaggcagtc

SEQ ID NO: 920 - DNA, 25 bp, Artificial Sequence
  Description of Artificial Sequence: Synthetic oligonucleotide
  Description of Combined DNA/RNA Molecule: Synthetic oligonucleotide
aaaaacaaaacaaacaaaaacaaaa

SEQ ID NO: 921 - DNA, 25 bp, Artificial Sequence
  Description of Artificial Sequence: Synthetic oligonucleotide
  Description of Combined DNA/RNA Molecule: Synthetic oligonucleotide
auaaaagaaaaagauaauaacucag

SEQ ID NO: 922 - DNA, 25 bp, Artificial Sequence
  Description of Artificial Sequence: Synthetic oligonucleotide
  Description of Combined DNA/RNA Molecule: Synthetic oligonucleotide
aaaaagauaauaacucaguucuuat

SEQ ID NO: 923 - DNA, 25 bp, Artificial Sequence
  Description of Artificial Sequence: Synthetic oligonucleotide
  Description of Combined DNA/RNA Molecule: Synthetic oligonucleotide
aauaacucaguucuuauuugcacct

SEQ ID NO: 924 - DNA, 25 bp, Artificial Sequence
  Description of Artificial Sequence: Synthetic oligonucleotide
  Description of Combined DNA/RNA Molecule: Synthetic oligonucleotide
guggaggauuuuguuuuuuucuutt

SEQ ID NO: 925 - DNA, 25 bp, Artificial Sequence
  Description of Artificial Sequence: Synthetic oligonucleotide
  Description of Combined DNA/RNA Molecule: Synthetic oligonucleotide
uuguuuuuuucuuuuaagaucuggg

SEQ ID NO: 926 - DNA, 25 bp, Artificial Sequence
  Description of Artificial Sequence: Synthetic oligonucleotide
  Description of Combined DNA/RNA Molecule: Synthetic oligonucleotide
uuuuucuuuuaagaucugggcauct

SEQ ID NO: 927 - DNA, 25 bp, Artificial Sequence
  Description of Artificial Sequence: Synthetic oligonucleotide
  Description of Combined DNA/RNA Molecule: Synthetic oligonucleotide
cugggcaucuuuugaaucuaccctt

SEQ ID NO: 928 - DNA, 25 bp, Artificial Sequence
  Description of Artificial Sequence: Synthetic oligonucleotide
  Description of Combined DNA/RNA Molecule: Synthetic oligonucleotide
agggaaguagguggaagauucagcc

SEQ ID NO: 929 - DNA, 25 bp, Artificial Sequence
  Description of Artificial Sequence: Synthetic oligonucleotide
  Description of Combined DNA/RNA Molecule: Synthetic oligonucleotide
ggagcuuuccagaaucuguuccaga

SEQ ID NO: 930 - DNA, 25 bp, Artificial Sequence
  Description of Artificial Sequence: Synthetic oligonucleotide
  Description of Combined DNA/RNA Molecule: Synthetic oligonucleotide
caggaagcaguauccgaaggcagca

SEQ ID NO: 931 - DNA, 25 bp, Artificial Sequence
  Description of Artificial Sequence: Synthetic oligonucleotide
  Description of Combined DNA/RNA Molecule: Synthetic oligonucleotide
aaggacaauuacuuagggggcactt

SEQ ID NO: 932 - DNA, 25 bp, Artificial Sequence
  Description of Artificial Sequence: Synthetic oligonucleotide
  Description of Combined DNA/RNA Molecule: Synthetic oligonucleotide
ggaguuguguaaggcagugucggtg

SEQ ID NO: 933 - DNA, 25 bp, Artificial Sequence
  Description of Artificial Sequence: Synthetic oligonucleotide
  Description of Combined DNA/RNA Molecule: Synthetic oligonucleotide
caagagcacugaagauacugcugag

SEQ ID NO: 934 - DNA, 25 bp, Artificial Sequence
  Description of Artificial Sequence: Synthetic oligonucleotide
  Description of Combined DNA/RNA Molecule: Synthetic oligonucleotide
ugaagauacugcugaguauucccct

SEQ ID NO: 935 - DNA, 25 bp, Artificial Sequence
  Description of Artificial Sequence: Synthetic oligonucleotide
  Description of Combined DNA/RNA Molecule: Synthetic oligonucleotide
agggagguuacaccaaagggcuaga

SEQ ID NO: 936 - DNA, 25 bp, Artificial Sequence
  Description of Artificial Sequence: Synthetic oligonucleotide
  Description of Combined DNA/RNA Molecule: Synthetic oligonucleotide
ugugucaaaagcgaaaugggcccct

SEQ ID NO: 937 - DNA, 25 bp, Artificial Sequence
  Description of Artificial Sequence: Synthetic oligonucleotide
  Description of Combined DNA/RNA Molecule: Synthetic oligonucleotide
guuuugcccauugacuauuacuutc

SEQ ID NO: 938 - DNA, 25 bp, Artificial Sequence
  Description of Artificial Sequence: Synthetic oligonucleotide
  Description of Combined DNA/RNA Molecule: Synthetic oligonucleotide
caaggucuucuucaaaagagccgct

SEQ ID NO: 939 - DNA, 25 bp, Artificial Sequence
  Description of Artificial Sequence: Synthetic oligonucleotide
  Description of Combined DNA/RNA Molecule: Synthetic oligonucleotide
gggaaacagaaguaccugugcgcca

SEQ ID NO: 940 - DNA, 25 bp, Artificial Sequence
  Description of Artificial Sequence: Synthetic oligonucleotide
  Description of Combined DNA/RNA Molecule: Synthetic oligonucleotide
gauugcacuauugauaaauuccgaa

SEQ ID NO: 941 - DNA, 25 bp, Artificial Sequence
  Description of Artificial Sequence: Synthetic oligonucleotide
  Description of Combined DNA/RNA Molecule: Synthetic oligonucleotide
aauuccgaaggaaaaauuguccatc

SEQ ID NO: 942 - DNA, 25 bp, Artificial Sequence
  Description of Artificial Sequence: Synthetic oligonucleotide
  Description of Combined DNA/RNA Molecule: Synthetic oligonucleotide
ggaaaaauuguccaucuugucguct

SEQ ID NO: 943 - DNA, 25 bp, Artificial Sequence
  Description of Artificial Sequence: Synthetic oligonucleotide
  Description of Combined DNA/RNA Molecule: Synthetic oligonucleotide
aaaauuguccaucuugucgucuucg

SEQ ID NO: 944 - DNA, 25 bp, Artificial Sequence
  Description of Artificial Sequence: Synthetic oligonucleotide
  Description of Combined DNA/RNA Molecule: Synthetic oligonucleotide
agaaacuugguaaucugaaacuaca

SEQ ID NO: 945 - DNA, 25 bp, Artificial Sequence
  Description of Artificial Sequence: Synthetic oligonucleotide
  Description of Combined DNA/RNA Molecule: Synthetic oligonucleotide
uugaaggcuaugaaugucagcccat

SEQ ID NO: 946 - DNA, 25 bp, Artificial Sequence
  Description of Artificial Sequence: Synthetic oligonucleotide
  Description of Combined DNA/RNA Molecule: Synthetic oligonucleotide
ggaauuccugugcaugaaagcactg

SEQ ID NO: 947 - DNA, 25 bp, Artificial Sequence
  Description of Artificial Sequence: Synthetic oligonucleotide
  Description of Combined DNA/RNA Molecule: Synthetic oligonucleotide
aaaaauucuuugaugaacuucgaat

SEQ ID NO: 948 - DNA, 25 bp, Artificial Sequence
  Description of Artificial Sequence: Synthetic oligonucleotide
  Description of Combined DNA/RNA Molecule: Synthetic oligonucleotide
uuugaugaacuucgaaugaacuaca

SEQ ID NO: 949 - DNA, 25 bp, Artificial Sequence
  Description of Artificial Sequence: Synthetic oligonucleotide
  Description of Combined DNA/RNA Molecule: Synthetic oligonucleotide
gaugaacuucgaaugaacuacauca

SEQ ID NO: 950 - DNA, 25 bp, Artificial Sequence
  Description of Artificial Sequence: Synthetic oligonucleotide
  Description of Combined DNA/RNA Molecule: Synthetic oligonucleotide
gaaugaacuacaucaaggaacucga

SEQ ID NO: 951 - DNA, 25 bp, Artificial Sequence
  Description of Artificial Sequence: Synthetic oligonucleotide
  Description of Combined DNA/RNA Molecule: Synthetic oligonucleotide
caaaagaaaaaaucccacauccugc

SEQ ID NO: 952 - DNA, 25 bp, Artificial Sequence
  Description of Artificial Sequence: Synthetic oligonucleotide
  Description of Combined DNA/RNA Molecule: Synthetic oligonucleotide
agaaaaaaucccacauccugcucaa

SEQ ID NO: 953 - DNA, 25 bp, Artificial Sequence
  Description of Artificial Sequence: Synthetic oligonucleotide
  Description of Combined DNA/RNA Molecule: Synthetic oligonucleotide
uuuugaccugcuaaucaagucacac

SEQ ID NO: 954 - DNA, 25 bp, Artificial Sequence
  Description of Artificial Sequence: Synthetic oligonucleotide
  Description of Combined DNA/RNA Molecule: Synthetic oligonucleotide
aagauccuuucugggaaagucaagc

SEQ ID NO: 955 - DNA, 25 bp, Artificial Sequence
  Description of Artificial Sequence: Synthetic oligonucleotide
  Description of Combined DNA/RNA Molecule: Synthetic oligonucleotide
aaagucaagcccaucuauuuccaca

SEQ ID NO: 956 - DNA, 25 bp, Artificial Sequence
  Description of Artificial Sequence: Synthetic oligonucleotide
  Description of Combined DNA/RNA Molecule: Synthetic oligonucleotide
augucuucugccuguuauaacuctg

SEQ ID NO: 957 - DNA, 25 bp, Artificial Sequence
  Description of Artificial Sequence: Synthetic oligonucleotide
  Description of Combined DNA/RNA Molecule: Synthetic oligonucleotide
gaauuuccucuauugauguacagtc

SEQ ID NO: 958 - DNA, 25 bp, Artificial Sequence
  Description of Artificial Sequence: Synthetic oligonucleotide
  Description of Combined DNA/RNA Molecule: Synthetic oligonucleotide
gauguacagucugucaugaacaugt

SEQ ID NO: 959 - DNA, 25 bp, Artificial Sequence
  Description of Artificial Sequence: Synthetic oligonucleotide
  Description of Combined DNA/RNA Molecule: Synthetic oligonucleotide
cagucugucaugaacauguuccuga

SEQ ID NO: 960 - DNA, 25 bp, Artificial Sequence
  Description of Artificial Sequence: Synthetic oligonucleotide
  Description of Combined DNA/RNA Molecule: Synthetic oligonucleotide
caugaacauguuccugaauucuatt

SEQ ID NO: 961 - DNA, 25 bp, Artificial Sequence
  Description of Artificial Sequence: Synthetic oligonucleotide
  Description of Combined DNA/RNA Molecule: Synthetic oligonucleotide
auguuccugaauucuauuugcuggg

SEQ ID NO: 962 - DNA, 25 bp, Artificial Sequence
  Description of Artificial Sequence: Synthetic oligonucleotide
  Description of Combined DNA/RNA Molecule: Synthetic oligonucleotide
ugggcuuuuuuuuucucuuucuctc

SEQ ID NO: 963 - DNA, 25 bp, Artificial Sequence
  Description of Artificial Sequence: Synthetic oligonucleotide
  Description of Combined DNA/RNA Molecule: Synthetic oligonucleotide
uuuuucucuuucucuccuuucuutt

SEQ ID NO: 964 - DNA, 25 bp, Artificial Sequence
  Description of Artificial Sequence: Synthetic oligonucleotide
  Description of Combined DNA/RNA Molecule: Synthetic oligonucleotide
guuuugaaugguguuguaugccutt

SEQ ID NO: 965 - DNA, 25 bp, Artificial Sequence
  Description of Artificial Sequence: Synthetic oligonucleotide
  Description of Combined DNA/RNA Molecule: Synthetic oligonucleotide
gguguuguaugccuuuaaaucugtg

SEQ ID NO: 966 - DNA, 25 bp, Artificial Sequence
  Description of Artificial Sequence: Synthetic oligonucleotide
  Description of Combined DNA/RNA Molecule: Synthetic oligonucleotide
caaguugugcuuguuuacagcacta

SEQ ID NO: 967 - DNA, 25 bp, Artificial Sequence
  Description of Artificial Sequence: Synthetic oligonucleotide
  Description of Combined DNA/RNA Molecule: Synthetic oligonucleotide
cuaagauuaucuggggaaaucaaaa

SEQ ID NO: 968 - DNA, 25 bp, Artificial Sequence
  Description of Artificial Sequence: Synthetic oligonucleotide
  Description of Combined DNA/RNA Molecule: Synthetic oligonucleotide
uggggaaaucaaaacaaaaacaagc

SEQ ID NO: 969 - DNA, 25 bp, Artificial Sequence
  Description of Artificial Sequence: Synthetic oligonucleotide
  Description of Combined DNA/RNA Molecule: Synthetic oligonucleotide
gaaaucaaaacaaaaacaagcaaac

SEQ ID NO: 970 - RNA, 27 nt, Artificial Sequence
  Description of Artificial Sequence: Synthetic oligonucleotide
uuuagcagcuuuuaaaaacuucaccga

SEQ ID NO: 971 - RNA, 27 nt, Artificial Sequence
  Description of Artificial Sequence: Synthetic oligonucleotide
ccgagucuuuagcagcuuuuaaaaacu

SEQ ID NO: 972 - RNA, 27 nt, Artificial Sequence
  Description of Artificial Sequence: Synthetic oligonucleotide
cgcagccaaagggaguuaccucucugc

SEQ ID NO: 973 - RNA, 27 nt, Artificial Sequence
  Description of Artificial Sequence: Synthetic oligonucleotide
gacugccuuuucaucuuuugaucucug

SEQ ID NO: 974 - RNA, 27 nt, Artificial Sequence
  Description of Artificial Sequence: Synthetic oligonucleotide
uuuuguuuuuguuuguuuuguuuuuug

SEQ ID NO: 975 - RNA, 27 nt, Artificial Sequence
  Description of Artificial Sequence: Synthetic oligonucleotide
cugaguuauuaucuuuuucuuuuauuu

SEQ ID NO: 976 - RNA, 27 nt, Artificial Sequence
  Description of Artificial Sequence: Synthetic oligonucleotide
auaagaacugaguuauuaucuuuuucu

SEQ ID NO: 977 - RNA, 27 nt, Artificial Sequence
  Description of Artificial Sequence: Synthetic oligonucleotide
aggugcaaauaagaacugaguuauuau

SEQ ID NO: 978 - RNA, 27 nt, Artificial Sequence
  Description of Artificial Sequence: Synthetic oligonucleotide
aaaagaaaaaaacaaaauccuccaccu

SEQ ID NO: 979 - RNA, 27 nt, Artificial Sequence
  Description of Artificial Sequence: Synthetic oligonucleotide
cccagaucuuaaaagaaaaaaacaaaa

SEQ ID NO: 980 - RNA, 27 nt, Artificial Sequence
  Description of Artificial Sequence: Synthetic oligonucleotide
agaugcccagaucuuaaaagaaaaaaa

SEQ ID NO: 981 - RNA, 27 nt, Artificial Sequence
  Description of Artificial Sequence: Synthetic oligonucleotide
aaggguagauucaaaagaugcccagau

SEQ ID NO: 982 - RNA, 27 nt, Artificial Sequence
  Description of Artificial Sequence: Synthetic oligonucleotide
ggcugaaucuuccaccuacuucccuua

SEQ ID NO: 983 - RNA, 27 nt, Artificial Sequence
  Description of Artificial Sequence: Synthetic oligonucleotide
ucuggaacagauucuggaaagcuccuc

SEQ ID NO: 984 - RNA, 27 nt, Artificial Sequence
  Description of Artificial Sequence: Synthetic oligonucleotide
ugcugccuucggauacugcuuccugcu

SEQ ID NO: 985 - RNA, 27 nt, Artificial Sequence
  Description of Artificial Sequence: Synthetic oligonucleotide
aagugcccccuaaguaauuguccuugg

SEQ ID NO: 986 - RNA, 27 nt, Artificial Sequence
  Description of Artificial Sequence: Synthetic oligonucleotide
caccgacacugccuuacacaacuccuu

SEQ ID NO: 987 - RNA, 27 nt, Artificial Sequence
  Description of Artificial Sequence: Synthetic oligonucleotide
cucagcaguaucuucagugcucuugcc

SEQ ID NO: 988 - RNA, 27 nt, Artificial Sequence
  Description of Artificial Sequence: Synthetic oligonucleotide
aggggaauacucagcaguaucuucagu

SEQ ID NO: 989 - RNA, 27 nt, Artificial Sequence
  Description of Artificial Sequence: Synthetic oligonucleotide
ucuagcccuuugguguaaccucccuug

SEQ ID NO: 990 - RNA, 27 nt, Artificial Sequence
  Description of Artificial Sequence: Synthetic oligonucleotide
aggggcccauuucgcuuuugacacaag

SEQ ID NO: 991 - RNA, 27 nt, Artificial Sequence
  Description of Artificial Sequence: Synthetic oligonucleotide
gaaaguaauagucaaugggcaaaacau

SEQ ID NO: 992 - RNA, 27 nt, Artificial Sequence
  Description of Artificial Sequence: Synthetic oligonucleotide
agcggcucuuuugaagaagaccuugca

SEQ ID NO: 993 - RNA, 27 nt, Artificial Sequence
  Description of Artificial Sequence: Synthetic oligonucleotide
uggcgcacagguacuucuguuucccuu

SEQ ID NO: 994 - RNA, 27 nt, Artificial Sequence
  Description of Artificial Sequence: Synthetic oligonucleotide
uucggaauuuaucaauagugcaaucau

SEQ ID NO: 995 - RNA, 27 nt, Artificial Sequence
  Description of Artificial Sequence: Synthetic oligonucleotide
gauggacaauuuuuccuucggaauuua

SEQ ID NO: 996 - RNA, 27 nt, Artificial Sequence
  Description of Artificial Sequence: Synthetic oligonucleotide
agacgacaagauggacaauuuuuccuu

SEQ ID NO: 997 - RNA, 27 nt, Artificial Sequence
  Description of Artificial Sequence: Synthetic oligonucleotide
cgaagacgacaagauggacaauuuuuc

SEQ ID NO: 998 - RNA, 27 nt, Artificial Sequence
  Description of Artificial Sequence: Synthetic oligonucleotide
uguaguuucagauuaccaaguuucuuc

SEQ ID NO: 999 - RNA, 27 nt, Artificial Sequence
  Description of Artificial Sequence: Synthetic oligonucleotide
augggcugacauucauagccuucaaug

SEQ ID NO: 1000 - RNA, 27 nt, Artificial Sequence
  Description of Artificial Sequence: Synthetic oligonucleotide
cagugcuuucaugcacaggaauuccug

SEQ ID NO: 1001 - RNA, 27 nt, Artificial Sequence
  Description of Artificial Sequence: Synthetic oligonucleotide
auucgaaguucaucaaagaauuuuuga

SEQ ID NO: 1002 - RNA, 27 nt, Artificial Sequence
  Description of Artificial Sequence: Synthetic oligonucleotide
uguaguucauucgaaguucaucaaaga

SEQ ID NO: 1003 - RNA, 27 nt, Artificial Sequence
  Description of Artificial Sequence: Synthetic oligonucleotide
ugauguaguucauucgaaguucaucaa

SEQ ID NO: 1004 - RNA, 27 nt, Artificial Sequence
  Description of Artificial Sequence: Synthetic oligonucleotide
ucgaguuccuugauguaguucauucga

SEQ ID NO: 1005 - RNA, 27 nt, Artificial Sequence
  Description of Artificial Sequence: Synthetic oligonucleotide
gcaggaugugggauuuuuucuuuugca

SEQ ID NO: 1006 - RNA, 27 nt, Artificial Sequence
  Description of Artificial Sequence: Synthetic oligonucleotide
uugagcaggaugugggauuuuuucuuu

SEQ ID NO: 1007 - RNA, 27 nt, Artificial Sequence
  Description of Artificial Sequence: Synthetic oligonucleotide
gugugacuugauuagcaggucaaaagu

SEQ ID NO: 1008 - RNA, 27 nt, Artificial Sequence
  Description of Artificial Sequence: Synthetic oligonucleotide
gcuugacuuucccagaaaggaucuugg

SEQ ID NO: 1009 - RNA, 27 nt, Artificial Sequence
  Description of Artificial Sequence: Synthetic oligonucleotide
uguggaaauagaugggcuugacuuucc

SEQ ID NO: 1010 - RNA, 27 nt, Artificial Sequence
  Description of Artificial Sequence: Synthetic oligonucleotide
cagaguuauaacaggcagaagacaucu

SEQ ID NO: 1011 - RNA, 27 nt, Artificial Sequence
  Description of Artificial Sequence: Synthetic oligonucleotide
gacuguacaucaauagaggaaauuccc

SEQ ID NO: 1012 - RNA, 27 nt, Artificial Sequence
  Description of Artificial Sequence: Synthetic oligonucleotide
acauguucaugacagacuguacaucaa

SEQ ID NO: 1013 - RNA, 27 nt, Artificial Sequence
  Description of Artificial Sequence: Synthetic oligonucleotide
ucaggaacauguucaugacagacugua

SEQ ID NO: 1014 - RNA, 27 nt, Artificial Sequence
  Description of Artificial Sequence: Synthetic oligonucleotide
aauagaauucaggaacauguucaugac

SEQ ID NO: 1015 - RNA, 27 nt, Artificial Sequence
  Description of Artificial Sequence: Synthetic oligonucleotide
cccagcaaauagaauucaggaacaugu

SEQ ID NO: 1016 - RNA, 27 nt, Artificial Sequence
  Description of Artificial Sequence: Synthetic oligonucleotide
gagagaaagagaaaaaaaaagcccagc

SEQ ID NO: 1017 - RNA, 27 nt, Artificial Sequence
  Description of Artificial Sequence: Synthetic oligonucleotide
aaaagaaaggagagaaagagaaaaaaa

SEQ ID NO: 1018 - RNA, 27 nt, Artificial Sequence
  Description of Artificial Sequence: Synthetic oligonucleotide
aaaggcauacaacaccauucaaaacac

SEQ ID NO: 1019 - RNA, 27 nt, Artificial Sequence
  Description of Artificial Sequence: Synthetic oligonucleotide
cacagauuuaaaggcauacaacaccau

SEQ ID NO: 1020 - RNA, 27 nt, Artificial Sequence
  Description of Artificial Sequence: Synthetic oligonucleotide
uagugcuguaaacaagcacaacuugac

SEQ ID NO: 1021 - RNA, 27 nt, Artificial Sequence
  Description of Artificial Sequence: Synthetic oligonucleotide
uuuugauuuccccagauaaucuuagcu

SEQ ID NO: 1022 - RNA, 27 nt, Artificial Sequence
  Description of Artificial Sequence: Synthetic oligonucleotide
gcuuguuuuuguuuugauuuccccaga

SEQ ID NO: 1023 - RNA, 27 nt, Artificial Sequence
  Description of Artificial Sequence: Synthetic oligonucleotide
guuugcuuguuuuuguuuugauuuccc

SEQ ID NO: 1024 - DNA, 27 bp, Artificial Sequence
  Description of Artificial Sequence: Synthetic oligonucleotide
tcggtgaagtttttaaaagctgctaaa

SEQ ID NO: 1025 - DNA, 27 bp, Artificial Sequence
  Description of Artificial Sequence: Synthetic oligonucleotide
agtttttaaaagctgctaaagactcgg

SEQ ID NO: 1026 - DNA, 27 bp, Artificial Sequence
  Description of Artificial Sequence: Synthetic oligonucleotide
gcagagaggtaactccctttggctgcg

SEQ ID NO: 1027 - DNA, 27 bp, Artificial Sequence
  Description of Artificial Sequence: Synthetic oligonucleotide
cagagatcaaaagatgaaaaggcagtc

SEQ ID NO: 1028 - DNA, 27 bp, Artificial Sequence
  Description of Artificial Sequence: Synthetic oligonucleotide
caaaaaacaaaacaaacaaaaacaaaa

SEQ ID NO: 1029 - DNA, 27 bp, Artificial Sequence
  Description of Artificial Sequence: Synthetic oligonucleotide
aaataaaagaaaaagataataactcag

SEQ ID NO: 1030 - DNA, 27 bp, Artificial Sequence
  Description of Artificial Sequence: Synthetic oligonucleotide
agaaaaagataataactcagttcttat

SEQ ID NO: 1031 - DNA, 27 bp, Artificial Sequence
  Description of Artificial Sequence: Synthetic oligonucleotide
ataataactcagttcttatttgcacct

SEQ ID NO: 1032 - DNA, 27 bp, Artificial Sequence
  Description of Artificial Sequence: Synthetic oligonucleotide
aggtggaggattttgtttttttctttt

SEQ ID NO: 1033 - DNA, 27 bp, Artificial Sequence
  Description of Artificial Sequence: Synthetic oligonucleotide
ttttgtttttttcttttaagatctggg

SEQ ID NO: 1034 - DNA, 27 bp, Artificial Sequence
  Description of Artificial Sequence: Synthetic oligonucleotide
tttttttcttttaagatctgggcatct

SEQ ID NO: 1035 - DNA, 27 bp, Artificial Sequence
  Description of Artificial Sequence: Synthetic oligonucleotide
atctgggcatcttttgaatctaccctt

SEQ ID NO: 1036 - DNA, 27 bp, Artificial Sequence
  Description of Artificial Sequence: Synthetic oligonucleotide
taagggaagtaggtggaagattcagcc

SEQ ID NO: 1037 - DNA, 27 bp, Artificial Sequence
  Description of Artificial Sequence: Synthetic oligonucleotide
gaggagctttccagaatctgttccaga

SEQ ID NO: 1038 - DNA, 27 bp, Artificial Sequence
  Description of Artificial Sequence: Synthetic oligonucleotide
agcaggaagcagtatccgaaggcagca

SEQ ID NO: 1039 - DNA, 27 bp, Artificial Sequence
  Description of Artificial Sequence: Synthetic oligonucleotide
ccaaggacaattacttagggggcactt

SEQ ID NO: 1040 - DNA, 27 bp, Artificial Sequence
  Description of Artificial Sequence: Synthetic oligonucleotide
aaggagttgtgtaaggcagtgtcggtg

SEQ ID NO: 1041 - DNA, 27 bp, Artificial Sequence
  Description of Artificial Sequence: Synthetic oligonucleotide
ggcaagagcactgaagatactgctgag

SEQ ID NO: 1042 - DNA, 27 bp, Artificial Sequence
  Description of Artificial Sequence: Synthetic oligonucleotide
actgaagatactgctgagtattcccct

SEQ ID NO: 1043 - DNA, 27 bp, Artificial Sequence
  Description of Artificial Sequence: Synthetic oligonucleotide
caagggaggttacaccaaagggctaga

SEQ ID NO: 1044 - DNA, 27 bp, Artificial Sequence
  Description of Artificial Sequence: Synthetic oligonucleotide
cttgtgtcaaaagcgaaatgggcccct

SEQ ID NO: 1045 - DNA, 27 bp, Artificial Sequence
  Description of Artificial Sequence: Synthetic oligonucleotide
atgttttgcccattgactattactttc

SEQ ID NO: 1046 - DNA, 27 bp, Artificial Sequence
  Description of Artificial Sequence: Synthetic oligonucleotide
tgcaaggtcttcttcaaaagagccgct

SEQ ID NO: 1047 - DNA, 27 bp, Artificial Sequence
  Description of Artificial Sequence: Synthetic oligonucleotide
aagggaaacagaagtacctgtgcgcca

SEQ ID NO: 1048 - DNA, 27 bp, Artificial Sequence
  Description of Artificial Sequence: Synthetic oligonucleotide
atgattgcactattgataaattccgaa

SEQ ID NO: 1049 - DNA, 27 bp, Artificial Sequence
  Description of Artificial Sequence: Synthetic oligonucleotide
taaattccgaaggaaaaattgtccatc

SEQ ID NO: 1050 - DNA, 27 bp, Artificial Sequence
  Description of Artificial Sequence: Synthetic oligonucleotide
aaggaaaaattgtccatcttgtcgtct

SEQ ID NO: 1051 - DNA, 27 bp, Artificial Sequence
  Description of Artificial Sequence: Synthetic oligonucleotide
gaaaaattgtccatcttgtcgtcttcg

SEQ ID NO: 1052 - DNA, 27 bp, Artificial Sequence
  Description of Artificial Sequence: Synthetic oligonucleotide
gaagaaacttggtaatctgaaactaca

SEQ ID NO: 1053 - DNA, 27 bp, Artificial Sequence
  Description of Artificial Sequence: Synthetic oligonucleotide
cattgaaggctatgaatgtcagcccat

SEQ ID NO: 1054 - DNA, 27 bp, Artificial Sequence
  Description of Artificial Sequence: Synthetic oligonucleotide
caggaattcctgtgcatgaaagcactg

SEQ ID NO: 1055 - DNA, 27 bp, Artificial Sequence
  Description of Artificial Sequence: Synthetic oligonucleotide
tcaaaaattctttgatgaacttcgaat

SEQ ID NO: 1056 - DNA, 27 bp, Artificial Sequence
  Description of Artificial Sequence: Synthetic oligonucleotide
tctttgatgaacttcgaatgaactaca

SEQ ID NO: 1057 - DNA, 27 bp, Artificial Sequence
  Description of Artificial Sequence: Synthetic oligonucleotide
ttgatgaacttcgaatgaactacatca

SEQ ID NO: 1058 - DNA, 27 bp, Artificial Sequence
  Description of Artificial Sequence: Synthetic oligonucleotide
tcgaatgaactacatcaaggaactcga

SEQ ID NO: 1059 - DNA, 27 bp, Artificial Sequence
  Description of Artificial Sequence: Synthetic oligonucleotide
tgcaaaagaaaaaatcccacatcctgc

SEQ ID NO: 1060 - DNA, 27 bp, Artificial Sequence
  Description of Artificial Sequence: Synthetic oligonucleotide
aaagaaaaaatcccacatcctgctcaa

SEQ ID NO: 1061 - DNA, 27 bp, Artificial Sequence
  Description of Artificial Sequence: Synthetic oligonucleotide
acttttgacctgctaatcaagtcacac

SEQ ID NO: 1062 - DNA, 27 bp, Artificial Sequence
  Description of Artificial Sequence: Synthetic oligonucleotide
ccaagatcctttctgggaaagtcaagc

SEQ ID NO: 1063 - DNA, 27 bp, Artificial Sequence
  Description of Artificial Sequence: Synthetic oligonucleotide
ggaaagtcaagcccatctatttccaca

SEQ ID NO: 1064 - DNA, 27 bp, Artificial Sequence
  Description of Artificial Sequence: Synthetic oligonucleotide
agatgtcttctgcctgttataactctg

SEQ ID NO: 1065 - DNA, 27 bp, Artificial Sequence
  Description of Artificial Sequence: Synthetic oligonucleotide
gggaatttcctctattgatgtacagtc

SEQ ID NO: 1066 - DNA, 27 bp, Artificial Sequence
  Description of Artificial Sequence: Synthetic oligonucleotide
ttgatgtacagtctgtcatgaacatgt

SEQ ID NO: 1067 - DNA, 27 bp, Artificial Sequence
  Description of Artificial Sequence: Synthetic oligonucleotide
tacagtctgtcatgaacatgttcctga

SEQ ID NO: 1068 - DNA, 27 bp, Artificial Sequence
  Description of Artificial Sequence: Synthetic oligonucleotide
gtcatgaacatgttcctgaattctatt

SEQ ID NO: 1069 - DNA, 27 bp, Artificial Sequence
  Description of Artificial Sequence: Synthetic oligonucleotide
acatgttcctgaattctatttgctggg

SEQ ID NO: 1070 - DNA, 27 bp, Artificial Sequence
  Description of Artificial Sequence: Synthetic oligonucleotide
gctgggctttttttttctctttctctc

SEQ ID NO: 1071 - DNA, 27 bp, Artificial Sequence
  Description of Artificial Sequence: Synthetic oligonucleotide
tttttttctctttctctcctttctttt

SEQ ID NO: 1072 - DNA, 27 bp, Artificial Sequence
  Description of Artificial Sequence: Synthetic oligonucleotide
gtgttttgaatggtgttgtatgccttt

SEQ ID NO: 1073 - DNA, 27 bp, Artificial Sequence
  Description of Artificial Sequence: Synthetic oligonucleotide
atggtgttgtatgcctttaaatctgtg

SEQ ID NO: 1074 - DNA, 27 bp, Artificial Sequence
  Description of Artificial Sequence: Synthetic oligonucleotide
gtcaagttgtgcttgtttacagcacta

SEQ ID NO: 1075 - DNA, 27 bp, Artificial Sequence
  Description of Artificial Sequence: Synthetic oligonucleotide
agctaagattatctggggaaatcaaaa

SEQ ID NO: 1076 - DNA, 27 bp, Artificial Sequence
  Description of Artificial Sequence: Synthetic oligonucleotide
tctggggaaatcaaaacaaaaacaagc

SEQ ID NO: 1077 - DNA, 27 bp, Artificial Sequence
  Description of Artificial Sequence: Synthetic oligonucleotide
gggaaatcaaaacaaaaacaagcaaac

SEQ ID NO: 1078 - RNA, 25 nt, Artificial Sequence
  Description of Artificial Sequence: Synthetic oligonucleotide
ggugaaguuuuuaaaagcugcuaaa

SEQ ID NO: 1079 - RNA, 25 nt, Artificial Sequence
  Description of Artificial Sequence: Synthetic oligonucleotide
uuuuuaaaagcugcuaaagacucgg

SEQ ID NO: 1080 - RNA, 25 nt, Artificial Sequence
  Description of Artificial Sequence: Synthetic oligonucleotide
agagagguaacucccuuuggcugcg

SEQ ID NO: 1081 - RNA, 25 nt, Artificial Sequence
  Description of Artificial Sequence: Synthetic oligonucleotide
gagaucaaaagaugaaaaggcaguc

SEQ ID NO: 1082 - RNA, 25 nt, Artificial Sequence
  Description of Artificial Sequence: Synthetic oligonucleotide
aaaaacaaaacaaacaaaaacaaaa

SEQ ID NO: 1083 - RNA, 25 nt, Artificial Sequence
  Description of Artificial Sequence: Synthetic oligonucleotide
auaaaagaaaaagauaauaacucag

SEQ ID NO: 1084 - RNA, 25 nt, Artificial Sequence
  Description of Artificial Sequence: Synthetic oligonucleotide
aaaaagauaauaacucaguucuuau

SEQ ID NO: 1085 - RNA, 25 nt, Artificial Sequence
  Description of Artificial Sequence: Synthetic oligonucleotide
aauaacucaguucuuauuugcaccu

SEQ ID NO: 1086 - RNA, 25 nt, Artificial Sequence
  Description of Artificial Sequence: Synthetic oligonucleotide
guggaggauuuuguuuuuuucuuuu

SEQ ID NO: 1087 - RNA, 25 nt, Artificial Sequence
  Description of Artificial Sequence: Synthetic oligonucleotide
uuguuuuuuucuuuuaagaucuggg

SEQ ID NO: 1088 - RNA, 25 nt, Artificial Sequence
  Description of Artificial Sequence: Synthetic oligonucleotide
uuuuucuuuuaagaucugggcaucu

SEQ ID NO: 1089 - RNA, 25 nt, Artificial Sequence
  Description of Artificial Sequence: Synthetic oligonucleotide
cugggcaucuuuugaaucuacccuu

SEQ ID NO: 1090 - RNA, 25 nt, Artificial Sequence
  Description of Artificial Sequence: Synthetic oligonucleotide
agggaaguagguggaagauucagcc

SEQ ID NO: 1091 - RNA, 25 nt, Artificial Sequence
  Description of Artificial Sequence: Synthetic oligonucleotide
ggagcuuuccagaaucuguuccaga

SEQ ID NO: 1092 - RNA, 25 nt, Artificial Sequence
  Description of Artificial Sequence: Synthetic oligonucleotide
caggaagcaguauccgaaggcagca

SEQ ID NO: 1093 - RNA, 25 nt, Artificial Sequence
  Description of Artificial Sequence: Synthetic oligonucleotide
aaggacaauuacuuagggggcacuu

SEQ ID NO: 1094 - RNA, 25 nt, Artificial Sequence
  Description of Artificial Sequence: Synthetic oligonucleotide
ggaguuguguaaggcagugucggug

SEQ ID NO: 1095 - RNA, 25 nt, Artificial Sequence
  Description of Artificial Sequence: Synthetic oligonucleotide
caagagcacugaagauacugcugag

SEQ ID NO: 1096 - RNA, 25 nt, Artificial Sequence
  Description of Artificial Sequence: Synthetic oligonucleotide
ugaagauacugcugaguauuccccu

SEQ ID NO: 1097 - RNA, 25 nt, Artificial Sequence
  Description of Artificial Sequence: Synthetic oligonucleotide
agggagguuacaccaaagggcuaga

SEQ ID NO: 1098 - RNA, 25 nt, Artificial Sequence
  Description of Artificial Sequence: Synthetic oligonucleotide
ugugucaaaagcgaaaugggccccu

SEQ ID NO: 1099 - RNA, 25 nt, Artificial Sequence
  Description of Artificial Sequence: Synthetic oligonucleotide
guuuugcccauugacuauuacuuuc

SEQ ID NO: 1100 - RNA, 25 nt, Artificial Sequence
  Description of Artificial Sequence: Synthetic oligonucleotide
caaggucuucuucaaaagagccgcu

SEQ ID NO: 1101 - RNA, 25 nt, Artificial Sequence
  Description of Artificial Sequence: Synthetic oligonucleotide
gggaaacagaaguaccugugcgcca

SEQ ID NO: 1102 - RNA, 25 nt, Artificial Sequence
  Description of Artificial Sequence: Synthetic oligonucleotide
gauugcacuauugauaaauuccgaa

SEQ ID NO: 1103 - RNA, 25 nt, Artificial Sequence
  Description of Artificial Sequence: Synthetic oligonucleotide
aauuccgaaggaaaaauuguccauc

SEQ ID NO: 1104 - RNA, 25 nt, Artificial Sequence
  Description of Artificial Sequence: Synthetic oligonucleotide
ggaaaaauuguccaucuugucgucu

SEQ ID NO: 1105 - RNA, 25 nt, Artificial Sequence
  Description of Artificial Sequence: Synthetic oligonucleotide
aaaauuguccaucuugucgucuucg

SEQ ID NO: 1106 - RNA, 25 nt, Artificial Sequence
  Description of Artificial Sequence: Synthetic oligonucleotide
agaaacuugguaaucugaaacuaca

SEQ ID NO: 1107 - RNA, 25 nt, Artificial Sequence
  Description of Artificial Sequence: Synthetic oligonucleotide
uugaaggcuaugaaugucagcccau

SEQ ID NO: 1108 - RNA, 25 nt, Artificial Sequence
  Description of Artificial Sequence: Synthetic oligonucleotide
ggaauuccugugcaugaaagcacug

SEQ ID NO: 1109 - RNA, 25 nt, Artificial Sequence
  Description of Artificial Sequence: Synthetic oligonucleotide
aaaaauucuuugaugaacuucgaau

SEQ ID NO: 1110 - RNA, 25 nt, Artificial Sequence
  Description of Artificial Sequence: Synthetic oligonucleotide
uuugaugaacuucgaaugaacuaca

SEQ ID NO: 1111 - RNA, 25 nt, Artificial Sequence
  Description of Artificial Sequence: Synthetic oligonucleotide
gaugaacuucgaaugaacuacauca

SEQ ID NO: 1112 - RNA, 25 nt, Artificial Sequence
  Description of Artificial Sequence: Synthetic oligonucleotide
gaaugaacuacaucaaggaacucga

SEQ ID NO: 1113 - RNA, 25 nt, Artificial Sequence
  Description of Artificial Sequence: Synthetic oligonucleotide
caaaagaaaaaaucccacauccugc

SEQ ID NO: 1114 - RNA, 25 nt, Artificial Sequence
  Description of Artificial Sequence: Synthetic oligonucleotide
agaaaaaaucccacauccugcucaa

SEQ ID NO: 1115 - RNA, 25 nt, Artificial Sequence
  Description of Artificial Sequence: Synthetic oligonucleotide
uuuugaccugcuaaucaagucacac

SEQ ID NO: 1116 - RNA, 25 nt, Artificial Sequence
  Description of Artificial Sequence: Synthetic oligonucleotide
aagauccuuucugggaaagucaagc

SEQ ID NO: 1117 - RNA, 25 nt, Artificial Sequence
  Description of Artificial Sequence: Synthetic oligonucleotide
aaagucaagcccaucuauuuccaca

SEQ ID NO: 1118 - RNA, 25 nt, Artificial Sequence
  Description of Artificial Sequence: Synthetic oligonucleotide
augucuucugccuguuauaacucug

SEQ ID NO: 1119 - RNA, 25 nt, Artificial Sequence
  Description of Artificial Sequence: Synthetic oligonucleotide
gaauuuccucuauugauguacaguc

SEQ ID NO: 1120 - RNA, 25 nt, Artificial Sequence
  Description of Artificial Sequence: Synthetic oligonucleotide
gauguacagucugucaugaacaugu

SEQ ID NO: 1121 - RNA, 25 nt, Artificial Sequence
  Description of Artificial Sequence: Synthetic oligonucleotide
cagucugucaugaacauguuccuga

SEQ ID NO: 1122 - RNA, 25 nt, Artificial Sequence
  Description of Artificial Sequence: Synthetic oligonucleotide
caugaacauguuccugaauucuauu

SEQ ID NO: 1123 - RNA, 25 nt, Artificial Sequence
  Description of Artificial Sequence: Synthetic oligonucleotide
auguuccugaauucuauuugcuggg

SEQ ID NO: 1124 - RNA, 25 nt, Artificial Sequence
  Description of Artificial Sequence: Synthetic oligonucleotide
ugggcuuuuuuuuucucuuucucuc

SEQ ID NO: 1125 - RNA, 25 nt, Artificial Sequence
  Description of Artificial Sequence: Synthetic oligonucleotide
uuuuucucuuucucuccuuucuuuu

SEQ ID NO: 1126 - RNA, 25 nt, Artificial Sequence
  Description of Artificial Sequence: Synthetic oligonucleotide
guuuugaaugguguuguaugccuuu

SEQ ID NO: 1127 - RNA, 25 nt, Artificial Sequence
  Description of Artificial Sequence: Synthetic oligonucleotide
gguguuguaugccuuuaaaucugug

SEQ ID NO: 1128 - RNA, 25 nt, Artificial Sequence
  Description of Artificial Sequence: Synthetic oligonucleotide
caaguugugcuuguuuacagcacua

SEQ ID NO: 1129 - RNA, 25 nt, Artificial Sequence
  Description of Artificial Sequence: Synthetic oligonucleotide
cuaagauuaucuggggaaaucaaaa

SEQ ID NO: 1130 - RNA, 25 nt, Artificial Sequence
  Description of Artificial Sequence: Synthetic oligonucleotide
uggggaaaucaaaacaaaaacaagc

SEQ ID NO: 1131 - RNA, 25 nt, Artificial Sequence
  Description of Artificial Sequence: Synthetic oligonucleotide
gaaaucaaaacaaaaacaagcaaac

SEQ ID NO: 1132 - DNA, 21 bp, Artificial Sequence
  Description of Artificial Sequence: Synthetic oligonucleotide
tcggtgaagtttttaaaagct

SEQ ID NO: 1133 - DNA, 21 bp, Artificial Sequence
  Description of Artificial Sequence: Synthetic oligonucleotide
agtttttaaaagctgctaaag

SEQ ID NO: 1134 - DNA, 21 bp, Artificial Sequence
  Description of Artificial Sequence: Synthetic oligonucleotide
gcagagaggtaactccctttg

SEQ ID NO: 1135 - DNA, 21 bp, Artificial Sequence
  Description of Artificial Sequence: Synthetic oligonucleotide
cagagatcaaaagatgaaaag

SEQ ID NO: 1136 - DNA, 21 bp, Artificial Sequence
  Description of Artificial Sequence: Synthetic oligonucleotide
caaaaaacaaaacaaacaaaa

SEQ ID NO: 1137 - DNA, 21 bp, Artificial Sequence
  Description of Artificial Sequence: Synthetic oligonucleotide
aaataaaagaaaaagataata

SEQ ID NO: 1138 - DNA, 21 bp, Artificial Sequence
  Description of Artificial Sequence: Synthetic oligonucleotide
agaaaaagataataactcagt

SEQ ID NO: 1139 - DNA, 21 bp, Artificial Sequence
  Description of Artificial Sequence: Synthetic oligonucleotide
ataataactcagttcttattt

SEQ ID NO: 1140 - DNA, 21 bp, Artificial Sequence
  Description of Artificial Sequence: Synthetic oligonucleotide
aggtggaggattttgtttttt

SEQ ID NO: 1141 - DNA, 21 bp, Artificial Sequence
  Description of Artificial Sequence: Synthetic oligonucleotide
ttttgtttttttcttttaaga

SEQ ID NO: 1142 - DNA, 21 bp, Artificial Sequence
  Description of Artificial Sequence: Synthetic oligonucleotide
tttttttcttttaagatctgg

SEQ ID NO: 1143 - DNA, 21 bp, Artificial Sequence
  Description of Artificial Sequence: Synthetic oligonucleotide
atctgggcatcttttgaatct

SEQ ID NO: 1144 - DNA, 21 bp, Artificial Sequence
  Description of Artificial Sequence: Synthetic oligonucleotide
taagggaagtaggtggaagat

SEQ ID NO: 1145 - DNA, 21 bp, Artificial Sequence
  Description of Artificial Sequence: Synthetic oligonucleotide
gaggagctttccagaatctgt

SEQ ID NO: 1146 - DNA, 21 bp, Artificial Sequence
  Description of Artificial Sequence: Synthetic oligonucleotide
agcaggaagcagtatccgaag

SEQ ID NO: 1147 - DNA, 21 bp, Artificial Sequence
  Description of Artificial Sequence: Synthetic oligonucleotide
ccaaggacaattacttagggg

SEQ ID NO: 1148 - DNA, 21 bp, Artificial Sequence
  Description of Artificial Sequence: Synthetic oligonucleotide
aaggagttgtgtaaggcagtg

SEQ ID NO: 1149 - DNA, 21 bp, Artificial Sequence
  Description of Artificial Sequence: Synthetic oligonucleotide
ggcaagagcactgaagatact

SEQ ID NO: 1150 - DNA, 21 bp, Artificial Sequence
  Description of Artificial Sequence: Synthetic oligonucleotide
actgaagatactgctgagtat

SEQ ID NO: 1151 - DNA, 21 bp, Artificial Sequence
  Description of Artificial Sequence: Synthetic oligonucleotide
caagggaggttacaccaaagg

SEQ ID NO: 1152 - DNA, 21 bp, Artificial Sequence
  Description of Artificial Sequence: Synthetic oligonucleotide
cttgtgtcaaaagcgaaatgg

SEQ ID NO: 1153 - DNA, 21 bp, Artificial Sequence
  Description of Artificial Sequence: Synthetic oligonucleotide
atgttttgcccattgactatt

SEQ ID NO: 1154 - DNA, 21 bp, Artificial Sequence
  Description of Artificial Sequence: Synthetic oligonucleotide
tgcaaggtcttcttcaaaaga

SEQ ID NO: 1155 - DNA, 21 bp, Artificial Sequence
  Description of Artificial Sequence: Synthetic oligonucleotide
aagggaaacagaagtacctgt

SEQ ID NO: 1156 - DNA, 21 bp, Artificial Sequence
  Description of Artificial Sequence: Synthetic oligonucleotide
atgattgcactattgataaat

SEQ ID NO: 1157 - DNA, 21 bp, Artificial Sequence
  Description of Artificial Sequence: Synthetic oligonucleotide
taaattccgaaggaaaaattg

SEQ ID NO: 1158 - DNA, 21 bp, Artificial Sequence
  Description of Artificial Sequence: Synthetic oligonucleotide
aaggaaaaattgtccatcttg

SEQ ID NO: 1159 - DNA, 21 bp, Artificial Sequence
  Description of Artificial Sequence: Synthetic oligonucleotide
gaaaaattgtccatcttgtcg

SEQ ID NO: 1160 - DNA, 21 bp, Artificial Sequence
  Description of Artificial Sequence: Synthetic oligonucleotide
gaagaaacttggtaatctgaa

SEQ ID NO: 1161 - DNA, 21 bp, Artificial Sequence
  Description of Artificial Sequence: Synthetic oligonucleotide
cattgaaggctatgaatgtca

SEQ ID NO: 1162 - DNA, 21 bp, Artificial Sequence
  Description of Artificial Sequence: Synthetic oligonucleotide
caggaattcctgtgcatgaaa

SEQ ID NO: 1163 - DNA, 21 bp, Artificial Sequence
  Description of Artificial Sequence: Synthetic oligonucleotide
tcaaaaattctttgatgaact

SEQ ID NO: 1164 - DNA, 21 bp, Artificial Sequence
  Description of Artificial Sequence: Synthetic oligonucleotide
tctttgatgaacttcgaatga

SEQ ID NO: 1165 - DNA, 21 bp, Artificial Sequence
  Description of Artificial Sequence: Synthetic oligonucleotide
ttgatgaacttcgaatgaact

SEQ ID NO: 1166 - DNA, 21 bp, Artificial Sequence
  Description of Artificial Sequence: Synthetic oligonucleotide
tcgaatgaactacatcaagga

SEQ ID NO: 1167 - DNA, 21 bp, Artificial Sequence
  Description of Artificial Sequence: Synthetic oligonucleotide
tgcaaaagaaaaaatcccaca

SEQ ID NO: 1168 - DNA, 21 bp, Artificial Sequence
  Description of Artificial Sequence: Synthetic oligonucleotide
aaagaaaaaatcccacatcct

SEQ ID NO: 1169 - DNA, 21 bp, Artificial Sequence
  Description of Artificial Sequence: Synthetic oligonucleotide
acttttgacctgctaatcaag

SEQ ID NO: 1170 - DNA, 21 bp, Artificial Sequence
  Description of Artificial Sequence: Synthetic oligonucleotide
ccaagatcctttctgggaaag

SEQ ID NO: 1171 - DNA, 21 bp, Artificial Sequence
  Description of Artificial Sequence: Synthetic oligonucleotide
ggaaagtcaagcccatctatt

SEQ ID NO: 1172 - DNA, 21 bp, Artificial Sequence
  Description of Artificial Sequence: Synthetic oligonucleotide
agatgtcttctgcctgttata

SEQ ID NO: 1173 - DNA, 21 bp, Artificial Sequence
  Description of Artificial Sequence: Synthetic oligonucleotide
gggaatttcctctattgatgt

SEQ ID NO: 1174 - DNA, 21 bp, Artificial Sequence
  Description of Artificial Sequence: Synthetic oligonucleotide
ttgatgtacagtctgtcatga

SEQ ID NO: 1175 - DNA, 21 bp, Artificial Sequence
  Description of Artificial Sequence: Synthetic oligonucleotide
tacagtctgtcatgaacatgt

SEQ ID NO: 1176 - DNA, 21 bp, Artificial Sequence
  Description of Artificial Sequence: Synthetic oligonucleotide
gtcatgaacatgttcctgaat

SEQ ID NO: 1177 - DNA, 21 bp, Artificial Sequence
  Description of Artificial Sequence: Synthetic oligonucleotide
acatgttcctgaattctattt

SEQ ID NO: 1178 - DNA, 21 bp, Artificial Sequence
  Description of Artificial Sequence: Synthetic oligonucleotide
gctgggctttttttttctctt

SEQ ID NO: 1179 - DNA, 21 bp, Artificial Sequence
  Description of Artificial Sequence: Synthetic oligonucleotide
tttttttctctttctctcctt

SEQ ID NO: 1180 - DNA, 21 bp, Artificial Sequence
  Description of Artificial Sequence: Synthetic oligonucleotide
gtgttttgaatggtgttgtat

SEQ ID NO: 1181 - DNA, 21 bp, Artificial Sequence
  Description of Artificial Sequence: Synthetic oligonucleotide
atggtgttgtatgcctttaaa

SEQ ID NO: 1182 - DNA, 21 bp, Artificial Sequence
  Description of Artificial Sequence: Synthetic oligonucleotide
gtcaagttgtgcttgtttaca

SEQ ID NO: 1183 - DNA, 21 bp, Artificial Sequence
  Description of Artificial Sequence: Synthetic oligonucleotide
agctaagattatctggggaaa

SEQ ID NO: 1184 - DNA, 21 bp, Artificial Sequence
  Description of Artificial Sequence: Synthetic oligonucleotide
tctggggaaatcaaaacaaaa

SEQ ID NO: 1185 - DNA, 21 bp, Artificial Sequence
  Description of Artificial Sequence: Synthetic oligonucleotide
gggaaatcaaaacaaaaacaa

SEQ ID NO: 1186 - DNA, 25 bp, Artificial Sequence
  Description of Artificial Sequence: Synthetic oligonucleotide
  Description of Combined DNA/RNA Molecule: Synthetic oligonucleotide
gugaaguuuuuaaaagcugcuaaag

SEQ ID NO: 1187 - DNA, 25 bp, Artificial Sequence
  Description of Artificial Sequence: Synthetic oligonucleotide
  Description of Combined DNA/RNA Molecule: Synthetic oligonucleotide
uuuuaaaagcugcuaaagacucgga

SEQ ID NO: 1188 - DNA, 25 bp, Artificial Sequence
  Description of Artificial Sequence: Synthetic oligonucleotide
  Description of Combined DNA/RNA Molecule: Synthetic oligonucleotide
uuaaaagcugcuaaagacucggagg

SEQ ID NO: 1189 - DNA, 25 bp, Artificial Sequence
  Description of Artificial Sequence: Synthetic oligonucleotide
  Description of Combined DNA/RNA Molecule: Synthetic oligonucleotide
ggagagaacccucuguuuuccccca

SEQ ID NO: 1190 - DNA, 25 bp, Artificial Sequence
  Description of Artificial Sequence: Synthetic oligonucleotide
  Description of Combined DNA/RNA Molecule: Synthetic oligonucleotide
agaucaaaagaugaaaaggcaguca

SEQ ID NO: 1191 - DNA, 25 bp, Artificial Sequence
  Description of Artificial Sequence: Synthetic oligonucleotide
  Description of Combined DNA/RNA Molecule: Synthetic oligonucleotide
caaaagaugaaaaggcagucaggtc

SEQ ID NO: 1192 - DNA, 25 bp, Artificial Sequence
  Description of Artificial Sequence: Synthetic oligonucleotide
  Description of Combined DNA/RNA Molecule: Synthetic oligonucleotide
caguagccaaaaaacaaaacaaaca

SEQ ID NO: 1193 - DNA, 25 bp, Artificial Sequence
  Description of Artificial Sequence: Synthetic oligonucleotide
  Description of Combined DNA/RNA Molecule: Synthetic oligonucleotide
aaaacaaaacaaacaaaaacaaaaa

SEQ ID NO: 1194 - DNA, 25 bp, Artificial Sequence
  Description of Artificial Sequence: Synthetic oligonucleotide
  Description of Combined DNA/RNA Molecule: Synthetic oligonucleotide
uaaaagaaaaagauaauaacucagt

SEQ ID NO: 1195 - DNA, 25 bp, Artificial Sequence
  Description of Artificial Sequence: Synthetic oligonucleotide
  Description of Combined DNA/RNA Molecule: Synthetic oligonucleotide
aaagaaaaagauaauaacucagutc

SEQ ID NO: 1196 - DNA, 25 bp, Artificial Sequence
  Description of Artificial Sequence: Synthetic oligonucleotide
  Description of Combined DNA/RNA Molecule: Synthetic oligonucleotide
aaaagauaauaacucaguucuuatt

SEQ ID NO: 1197 - DNA, 25 bp, Artificial Sequence
  Description of Artificial Sequence: Synthetic oligonucleotide
  Description of Combined DNA/RNA Molecule: Synthetic oligonucleotide
auaacucaguucuuauuugcaccta

SEQ ID NO: 1198 - DNA, 25 bp, Artificial Sequence
  Description of Artificial Sequence: Synthetic oligonucleotide
  Description of Combined DNA/RNA Molecule: Synthetic oligonucleotide
caguucuuauuugcaccuacuucag

SEQ ID NO: 1199 - DNA, 25 bp, Artificial Sequence
  Description of Artificial Sequence: Synthetic oligonucleotide
  Description of Combined DNA/RNA Molecule: Synthetic oligonucleotide
uggaggauuuuguuuuuuucuuuta

SEQ ID NO: 1200 - DNA, 25 bp, Artificial Sequence
  Description of Artificial Sequence: Synthetic oligonucleotide
  Description of Combined DNA/RNA Molecule: Synthetic oligonucleotide
uguuuuuuucuuuuaagaucugggc

SEQ ID NO: 1201 - DNA, 25 bp, Artificial Sequence
  Description of Artificial Sequence: Synthetic oligonucleotide
  Description of Combined DNA/RNA Molecule: Synthetic oligonucleotide
uuuucuuuuaagaucugggcauctt

SEQ ID NO: 1202 - DNA, 25 bp, Artificial Sequence
  Description of Artificial Sequence: Synthetic oligonucleotide
  Description of Combined DNA/RNA Molecule: Synthetic oligonucleotide
ugggcaucuuuugaaucuacccutc

SEQ ID NO: 1203 - DNA, 25 bp, Artificial Sequence
  Description of Artificial Sequence: Synthetic oligonucleotide
  Description of Combined DNA/RNA Molecule: Synthetic oligonucleotide
caaguuuccuucucuggagcuuccc

SEQ ID NO: 1204 - DNA, 25 bp, Artificial Sequence
  Description of Artificial Sequence: Synthetic oligonucleotide
  Description of Combined DNA/RNA Molecule: Synthetic oligonucleotide
gggaaguagguggaagauucagcca

SEQ ID NO: 1205 - DNA, 25 bp, Artificial Sequence
  Description of Artificial Sequence: Synthetic oligonucleotide
  Description of Combined DNA/RNA Molecule: Synthetic oligonucleotide
aaguagguggaagauucagccaagc

SEQ ID NO: 1206 - DNA, 25 bp, Artificial Sequence
  Description of Artificial Sequence: Synthetic oligonucleotide
  Description of Combined DNA/RNA Molecule: Synthetic oligonucleotide
aggacaauuacuuagggggcacutc

SEQ ID NO: 1207 - DNA, 25 bp, Artificial Sequence
  Description of Artificial Sequence: Synthetic oligonucleotide
  Description of Combined DNA/RNA Molecule: Synthetic oligonucleotide
cgaaugcaaagguucucugcuagac

SEQ ID NO: 1208 - DNA, 25 bp, Artificial Sequence
  Description of Artificial Sequence: Synthetic oligonucleotide
  Description of Combined DNA/RNA Molecule: Synthetic oligonucleotide
aagagcacugaagauacugcugagt

SEQ ID NO: 1209 - DNA, 25 bp, Artificial Sequence
  Description of Artificial Sequence: Synthetic oligonucleotide
  Description of Combined DNA/RNA Molecule: Synthetic oligonucleotide
gaagauacugcugaguauucccctt

SEQ ID NO: 1210 - DNA, 25 bp, Artificial Sequence
  Description of Artificial Sequence: Synthetic oligonucleotide
  Description of Combined DNA/RNA Molecule: Synthetic oligonucleotide
gugucaaaagcgaaaugggcccctg

SEQ ID NO: 1211 - DNA, 25 bp, Artificial Sequence
  Description of Artificial Sequence: Synthetic oligonucleotide
  Description of Combined DNA/RNA Molecule: Synthetic oligonucleotide
uuuugcccauugacuauuacuuucc

SEQ ID NO: 1212 - DNA, 25 bp, Artificial Sequence
  Description of Artificial Sequence: Synthetic oligonucleotide
  Description of Combined DNA/RNA Molecule: Synthetic oligonucleotide
cauugacuauuacuuuccaccccag

SEQ ID NO: 1213 - DNA, 25 bp, Artificial Sequence
  Description of Artificial Sequence: Synthetic oligonucleotide
  Description of Combined DNA/RNA Molecule: Synthetic oligonucleotide
aaggucuucuucaaaagagccgctg

SEQ ID NO: 1214 - DNA, 25 bp, Artificial Sequence
  Description of Artificial Sequence: Synthetic oligonucleotide
  Description of Combined DNA/RNA Molecule: Synthetic oligonucleotide
auugcacuauugauaaauuccgaag

SEQ ID NO: 1215 - DNA, 25 bp, Artificial Sequence
  Description of Artificial Sequence: Synthetic oligonucleotide
  Description of Combined DNA/RNA Molecule: Synthetic oligonucleotide
cgaaggaaaaauuguccaucuugtc

SEQ ID NO: 1216 - DNA, 25 bp, Artificial Sequence
  Description of Artificial Sequence: Synthetic oligonucleotide
  Description of Combined DNA/RNA Molecule: Synthetic oligonucleotide
gaaaaauuguccaucuugucguctt

SEQ ID NO: 1217 - DNA, 25 bp, Artificial Sequence
  Description of Artificial Sequence: Synthetic oligonucleotide
  Description of Combined DNA/RNA Molecule: Synthetic oligonucleotide
cagugucacacauugaaggcuauga

SEQ ID NO: 1218 - DNA, 25 bp, Artificial Sequence
  Description of Artificial Sequence: Synthetic oligonucleotide
  Description of Combined DNA/RNA Molecule: Synthetic oligonucleotide
ugaaggcuaugaaugucagcccatc

SEQ ID NO: 1219 - DNA, 25 bp, Artificial Sequence
  Description of Artificial Sequence: Synthetic oligonucleotide
  Description of Combined DNA/RNA Molecule: Synthetic oligonucleotide
auggcugucauucaguacuccugga

SEQ ID NO: 1220 - DNA, 25 bp, Artificial Sequence
  Description of Artificial Sequence: Synthetic oligonucleotide
  Description of Combined DNA/RNA Molecule: Synthetic oligonucleotide
ugguuuucaaugaguaccgcaugca

SEQ ID NO: 1221 - DNA, 25 bp, Artificial Sequence
  Description of Artificial Sequence: Synthetic oligonucleotide
  Description of Combined DNA/RNA Molecule: Synthetic oligonucleotide
gaauuccugugcaugaaagcacugc

SEQ ID NO: 1222 - DNA, 25 bp, Artificial Sequence
  Description of Artificial Sequence: Synthetic oligonucleotide
  Description of Combined DNA/RNA Molecule: Synthetic oligonucleotide
aaaauucuuugaugaacuucgaatg

SEQ ID NO: 1223 - DNA, 25 bp, Artificial Sequence
  Description of Artificial Sequence: Synthetic oligonucleotide
  Description of Combined DNA/RNA Molecule: Synthetic oligonucleotide
uugaugaacuucgaaugaacuacat

SEQ ID NO: 1224 - DNA, 25 bp, Artificial Sequence
  Description of Artificial Sequence: Synthetic oligonucleotide
  Description of Combined DNA/RNA Molecule: Synthetic oligonucleotide
augaacuucgaaugaacuacaucaa

SEQ ID NO: 1225 - DNA, 25 bp, Artificial Sequence
  Description of Artificial Sequence: Synthetic oligonucleotide
  Description of Combined DNA/RNA Molecule: Synthetic oligonucleotide
aaugaacuacaucaaggaacucgat

SEQ ID NO: 1226 - DNA, 25 bp, Artificial Sequence
  Description of Artificial Sequence: Synthetic oligonucleotide
  Description of Combined DNA/RNA Molecule: Synthetic oligonucleotide
ugaacuacaucaaggaacucgaucg

SEQ ID NO: 1227 - DNA, 25 bp, Artificial Sequence
  Description of Artificial Sequence: Synthetic oligonucleotide
  Description of Combined DNA/RNA Molecule: Synthetic oligonucleotide
aaaagaaaaaaucccacauccugct

SEQ ID NO: 1228 - DNA, 25 bp, Artificial Sequence
  Description of Artificial Sequence: Synthetic oligonucleotide
  Description of Combined DNA/RNA Molecule: Synthetic oligonucleotide
gaaaaaaucccacauccugcucaag

SEQ ID NO: 1229 - DNA, 25 bp, Artificial Sequence
  Description of Artificial Sequence: Synthetic oligonucleotide
  Description of Combined DNA/RNA Molecule: Synthetic oligonucleotide
uuugaccugcuaaucaagucacaca

SEQ ID NO: 1230 - DNA, 25 bp, Artificial Sequence
  Description of Artificial Sequence: Synthetic oligonucleotide
  Description of Combined DNA/RNA Molecule: Synthetic oligonucleotide
cuguuauaacucugcacuacucctc

SEQ ID NO: 1231 - DNA, 25 bp, Artificial Sequence
  Description of Artificial Sequence: Synthetic oligonucleotide
  Description of Combined DNA/RNA Molecule: Synthetic oligonucleotide
guuauaacucugcacuacuccuctg

SEQ ID NO: 1232 - DNA, 25 bp, Artificial Sequence
  Description of Artificial Sequence: Synthetic oligonucleotide
  Description of Combined DNA/RNA Molecule: Synthetic oligonucleotide
aauuuccucuauugauguacaguct

SEQ ID NO: 1233 - DNA, 25 bp, Artificial Sequence
  Description of Artificial Sequence: Synthetic oligonucleotide
  Description of Combined DNA/RNA Molecule: Synthetic oligonucleotide
cuauugauguacagucugucaugaa

SEQ ID NO: 1234 - DNA, 25 bp, Artificial Sequence
  Description of Artificial Sequence: Synthetic oligonucleotide
  Description of Combined DNA/RNA Molecule: Synthetic oligonucleotide
augaacauguuccugaauucuautt

SEQ ID NO: 1235 - DNA, 25 bp, Artificial Sequence
  Description of Artificial Sequence: Synthetic oligonucleotide
  Description of Combined DNA/RNA Molecule: Synthetic oligonucleotide
cugaauucuauuugcugggcuuutt

SEQ ID NO: 1236 - DNA, 25 bp, Artificial Sequence
  Description of Artificial Sequence: Synthetic oligonucleotide
  Description of Combined DNA/RNA Molecule: Synthetic oligonucleotide
uuuuuuuuucucuuucucuccuutc

SEQ ID NO: 1237 - DNA, 25 bp, Artificial Sequence
  Description of Artificial Sequence: Synthetic oligonucleotide
  Description of Combined DNA/RNA Molecule: Synthetic oligonucleotide
uuuucucuuucucuccuuucuuutt

SEQ ID NO: 1238 - DNA, 25 bp, Artificial Sequence
  Description of Artificial Sequence: Synthetic oligonucleotide
  Description of Combined DNA/RNA Molecule: Synthetic oligonucleotide
cuuucucuccuuucuuuuucuuctt

SEQ ID NO: 1239 - DNA, 25 bp, Artificial Sequence
  Description of Artificial Sequence: Synthetic oligonucleotide
  Description of Combined DNA/RNA Molecule: Synthetic oligonucleotide
auggcaccuucagacuuugcuuccc

SEQ ID NO: 1240 - DNA, 25 bp, Artificial Sequence
  Description of Artificial Sequence: Synthetic oligonucleotide
  Description of Combined DNA/RNA Molecule: Synthetic oligonucleotide
uuuugaaugguguuguaugccuuta

SEQ ID NO: 1241 - DNA, 25 bp, Artificial Sequence
  Description of Artificial Sequence: Synthetic oligonucleotide
  Description of Combined DNA/RNA Molecule: Synthetic oligonucleotide
guguuguaugccuuuaaaucuguga

SEQ ID NO: 1242 - DNA, 25 bp, Artificial Sequence
  Description of Artificial Sequence: Synthetic oligonucleotide
  Description of Combined DNA/RNA Molecule: Synthetic oligonucleotide
uuaaaucugugaugauccucauatg

SEQ ID NO: 1243 - DNA, 25 bp, Artificial Sequence
  Description of Artificial Sequence: Synthetic oligonucleotide
  Description of Combined DNA/RNA Molecule: Synthetic oligonucleotide
ugugaugauccucauauggcccagt

SEQ ID NO: 1244 - DNA, 25 bp, Artificial Sequence
  Description of Artificial Sequence: Synthetic oligonucleotide
  Description of Combined DNA/RNA Molecule: Synthetic oligonucleotide
guugugcuuguuuacagcacuactc

SEQ ID NO: 1245 - DNA, 25 bp, Artificial Sequence
  Description of Artificial Sequence: Synthetic oligonucleotide
  Description of Combined DNA/RNA Molecule: Synthetic oligonucleotide
guuuacuuaucuuaugccacgggaa

SEQ ID NO: 1246 - DNA, 25 bp, Artificial Sequence
  Description of Artificial Sequence: Synthetic oligonucleotide
  Description of Combined DNA/RNA Molecule: Synthetic oligonucleotide
uuuagagagcuaagauuaucugggg

SEQ ID NO: 1247 - DNA, 25 bp, Artificial Sequence
  Description of Artificial Sequence: Synthetic oligonucleotide
  Description of Combined DNA/RNA Molecule: Synthetic oligonucleotide
uaagauuaucuggggaaaucaaaac

SEQ ID NO: 1248 - DNA, 25 bp, Artificial Sequence
  Description of Artificial Sequence: Synthetic oligonucleotide
  Description of Combined DNA/RNA Molecule: Synthetic oligonucleotide
ggggaaaucaaaacaaaaacaagca

SEQ ID NO: 1249 - RNA, 27 nt, Artificial Sequence
  Description of Artificial Sequence: Synthetic oligonucleotide
cuuuagcagcuuuuaaaaacuucaccg

SEQ ID NO: 1250 - RNA, 27 nt, Artificial Sequence
  Description of Artificial Sequence: Synthetic oligonucleotide
uccgagucuuuagcagcuuuuaaaaac

SEQ ID NO: 1251 - RNA, 27 nt, Artificial Sequence
  Description of Artificial Sequence: Synthetic oligonucleotide
ccuccgagucuuuagcagcuuuuaaaa

SEQ ID NO: 1252 - RNA, 27 nt, Artificial Sequence
  Description of Artificial Sequence: Synthetic oligonucleotide
ugggggaaaacagaggguucucuccgc

SEQ ID NO: 1253 - RNA, 27 nt, Artificial Sequence
  Description of Artificial Sequence: Synthetic oligonucleotide
ugacugccuuuucaucuuuugaucucu

SEQ ID NO: 1254 - RNA, 27 nt, Artificial Sequence
  Description of Artificial Sequence: Synthetic oligonucleotide
gaccugacugccuuuucaucuuuugau

SEQ ID NO: 1255 - RNA, 27 nt, Artificial Sequence
  Description of Artificial Sequence: Synthetic oligonucleotide
uguuuguuuuguuuuuuggcuacugaa

SEQ ID NO: 1256 - RNA, 27 nt, Artificial Sequence
  Description of Artificial Sequence: Synthetic oligonucleotide
uuuuuguuuuuguuuguuuuguuuuuu

SEQ ID NO: 1257 - RNA, 27 nt, Artificial Sequence
  Description of Artificial Sequence: Synthetic oligonucleotide
acugaguuauuaucuuuuucuuuuauu

SEQ ID NO: 1258 - RNA, 27 nt, Artificial Sequence
  Description of Artificial Sequence: Synthetic oligonucleotide
gaacugaguuauuaucuuuuucuuuua

SEQ ID NO: 1259 - RNA, 27 nt, Artificial Sequence
  Description of Artificial Sequence: Synthetic oligonucleotide
aauaagaacugaguuauuaucuuuuuc

SEQ ID NO: 1260 - RNA, 27 nt, Artificial Sequence
  Description of Artificial Sequence: Synthetic oligonucleotide
uaggugcaaauaagaacugaguuauua

SEQ ID NO: 1261 - RNA, 27 nt, Artificial Sequence
  Description of Artificial Sequence: Synthetic oligonucleotide
cugaaguaggugcaaauaagaacugag

SEQ ID NO: 1262 - RNA, 27 nt, Artificial Sequence
  Description of Artificial Sequence: Synthetic oligonucleotide
uaaaagaaaaaaacaaaauccuccacc

SEQ ID NO: 1263 - RNA, 27 nt, Artificial Sequence
  Description of Artificial Sequence: Synthetic oligonucleotide
gcccagaucuuaaaagaaaaaaacaaa

SEQ ID NO: 1264 - RNA, 27 nt, Artificial Sequence
  Description of Artificial Sequence: Synthetic oligonucleotide
aagaugcccagaucuuaaaagaaaaaa

SEQ ID NO: 1265 - RNA, 27 nt, Artificial Sequence
  Description of Artificial Sequence: Synthetic oligonucleotide
gaaggguagauucaaaagaugcccaga

SEQ ID NO: 1266 - RNA, 27 nt, Artificial Sequence
  Description of Artificial Sequence: Synthetic oligonucleotide
gggaagcuccagagaaggaaacuugcg

SEQ ID NO: 1267 - RNA, 27 nt, Artificial Sequence
  Description of Artificial Sequence: Synthetic oligonucleotide
uggcugaaucuuccaccuacuucccuu

SEQ ID NO: 1268 - RNA, 27 nt, Artificial Sequence
  Description of Artificial Sequence: Synthetic oligonucleotide
gcuuggcugaaucuuccaccuacuucc

SEQ ID NO: 1269 - RNA, 27 nt, Artificial Sequence
  Description of Artificial Sequence: Synthetic oligonucleotide
gaagugcccccuaaguaauuguccuug

SEQ ID NO: 1270 - RNA, 27 nt, Artificial Sequence
  Description of Artificial Sequence: Synthetic oligonucleotide
gucuagcagagaaccuuugcauucggc

SEQ ID NO: 1271 - RNA, 27 nt, Artificial Sequence
  Description of Artificial Sequence: Synthetic oligonucleotide
acucagcaguaucuucagugcucuugc

SEQ ID NO: 1272 - RNA, 27 nt, Artificial Sequence
  Description of Artificial Sequence: Synthetic oligonucleotide
aaggggaauacucagcaguaucuucag

SEQ ID NO: 1273 - RNA, 27 nt, Artificial Sequence
  Description of Artificial Sequence: Synthetic oligonucleotide
caggggcccauuucgcuuuugacacaa

SEQ ID NO: 1274 - RNA, 27 nt, Artificial Sequence
  Description of Artificial Sequence: Synthetic oligonucleotide
ggaaaguaauagucaaugggcaaaaca

SEQ ID NO: 1275 - RNA, 27 nt, Artificial Sequence
  Description of Artificial Sequence: Synthetic oligonucleotide
cugggguggaaaguaauagucaauggg

SEQ ID NO: 1276 - RNA, 27 nt, Artificial Sequence
  Description of Artificial Sequence: Synthetic oligonucleotide
cagcggcucuuuugaagaagaccuugc

SEQ ID NO: 1277 - RNA, 27 nt, Artificial Sequence
  Description of Artificial Sequence: Synthetic oligonucleotide
cuucggaauuuaucaauagugcaauca

SEQ ID NO: 1278 - RNA, 27 nt, Artificial Sequence
  Description of Artificial Sequence: Synthetic oligonucleotide
gacaagauggacaauuuuuccuucgga

SEQ ID NO: 1279 - RNA, 27 nt, Artificial Sequence
  Description of Artificial Sequence: Synthetic oligonucleotide
aagacgacaagauggacaauuuuuccu

SEQ ID NO: 1280 - RNA, 27 nt, Artificial Sequence
  Description of Artificial Sequence: Synthetic oligonucleotide
ucauagccuucaaugugugacacuguc

SEQ ID NO: 1281 - RNA, 27 nt, Artificial Sequence
  Description of Artificial Sequence: Synthetic oligonucleotide
gaugggcugacauucauagccuucaau

SEQ ID NO: 1282 - RNA, 27 nt, Artificial Sequence
  Description of Artificial Sequence: Synthetic oligonucleotide
uccaggaguacugaaugacagccaucu

SEQ ID NO: 1283 - RNA, 27 nt, Artificial Sequence
  Description of Artificial Sequence: Synthetic oligonucleotide
ugcaugcgguacucauugaaaaccaga

SEQ ID NO: 1284 - RNA, 27 nt, Artificial Sequence
  Description of Artificial Sequence: Synthetic oligonucleotide
gcagugcuuucaugcacaggaauuccu

SEQ ID NO: 1285 - RNA, 27 nt, Artificial Sequence
  Description of Artificial Sequence: Synthetic oligonucleotide
cauucgaaguucaucaaagaauuuuug

SEQ ID NO: 1286 - RNA, 27 nt, Artificial Sequence
  Description of Artificial Sequence: Synthetic oligonucleotide
auguaguucauucgaaguucaucaaag

SEQ ID NO: 1287 - RNA, 27 nt, Artificial Sequence
  Description of Artificial Sequence: Synthetic oligonucleotide
uugauguaguucauucgaaguucauca

SEQ ID NO: 1288 - RNA, 27 nt, Artificial Sequence
  Description of Artificial Sequence: Synthetic oligonucleotide
aucgaguuccuugauguaguucauucg

SEQ ID NO: 1289 - RNA, 27 nt, Artificial Sequence
  Description of Artificial Sequence: Synthetic oligonucleotide
cgaucgaguuccuugauguaguucauu

SEQ ID NO: 1290 - RNA, 27 nt, Artificial Sequence
  Description of Artificial Sequence: Synthetic oligonucleotide
agcaggaugugggauuuuuucuuuugc

SEQ ID NO: 1291 - RNA, 27 nt, Artificial Sequence
  Description of Artificial Sequence: Synthetic oligonucleotide
cuugagcaggaugugggauuuuuucuu

SEQ ID NO: 1292 - RNA, 27 nt, Artificial Sequence
  Description of Artificial Sequence: Synthetic oligonucleotide
ugugugacuugauuagcaggucaaaag

SEQ ID NO: 1293 - RNA, 27 nt, Artificial Sequence
  Description of Artificial Sequence: Synthetic oligonucleotide
gaggaguagugcagaguuauaacaggc

SEQ ID NO: 1294 - RNA, 27 nt, Artificial Sequence
  Description of Artificial Sequence: Synthetic oligonucleotide
cagaggaguagugcagaguuauaacag

SEQ ID NO: 1295 - RNA, 27 nt, Artificial Sequence
  Description of Artificial Sequence: Synthetic oligonucleotide
agacuguacaucaauagaggaaauucc

SEQ ID NO: 1296 - RNA, 27 nt, Artificial Sequence
  Description of Artificial Sequence: Synthetic oligonucleotide
uucaugacagacuguacaucaauagag

SEQ ID NO: 1297 - RNA, 27 nt, Artificial Sequence
  Description of Artificial Sequence: Synthetic oligonucleotide
aaauagaauucaggaacauguucauga

SEQ ID NO: 1298 - RNA, 27 nt, Artificial Sequence
  Description of Artificial Sequence: Synthetic oligonucleotide
aaaaagcccagcaaauagaauucagga

SEQ ID NO: 1299 - RNA, 27 nt, Artificial Sequence
  Description of Artificial Sequence: Synthetic oligonucleotide
gaaaggagagaaagagaaaaaaaaagc

SEQ ID NO: 1300 - RNA, 27 nt, Artificial Sequence
  Description of Artificial Sequence: Synthetic oligonucleotide
aaaaagaaaggagagaaagagaaaaaa

SEQ ID NO: 1301 - RNA, 27 nt, Artificial Sequence
  Description of Artificial Sequence: Synthetic oligonucleotide
aagaagaaaaagaaaggagagaaagag

SEQ ID NO: 1302 - RNA, 27 nt, Artificial Sequence
  Description of Artificial Sequence: Synthetic oligonucleotide
gggaagcaaagucugaaggugccaugg

SEQ ID NO: 1303 - RNA, 27 nt, Artificial Sequence
  Description of Artificial Sequence: Synthetic oligonucleotide
uaaaggcauacaacaccauucaaaaca

SEQ ID NO: 1304 - RNA, 27 nt, Artificial Sequence
  Description of Artificial Sequence: Synthetic oligonucleotide
ucacagauuuaaaggcauacaacacca

SEQ ID NO: 1305 - RNA, 27 nt, Artificial Sequence
  Description of Artificial Sequence: Synthetic oligonucleotide
cauaugaggaucaucacagauuuaaag

SEQ ID NO: 1306 - RNA, 27 nt, Artificial Sequence
  Description of Artificial Sequence: Synthetic oligonucleotide
acugggccauaugaggaucaucacaga

SEQ ID NO: 1307 - RNA, 27 nt, Artificial Sequence
  Description of Artificial Sequence: Synthetic oligonucleotide
gaguagugcuguaaacaagcacaacuu

SEQ ID NO: 1308 - RNA, 27 nt, Artificial Sequence
  Description of Artificial Sequence: Synthetic oligonucleotide
uucccguggcauaagauaaguaaacgu

SEQ ID NO: 1309 - RNA, 27 nt, Artificial Sequence
  Description of Artificial Sequence: Synthetic oligonucleotide
ccccagauaaucuuagcucucuaaacu

SEQ ID NO: 1310 - RNA, 27 nt, Artificial Sequence
  Description of Artificial Sequence: Synthetic oligonucleotide
guuuugauuuccccagauaaucuuagc

SEQ ID NO: 1311 - RNA, 27 nt, Artificial Sequence
  Description of Artificial Sequence: Synthetic oligonucleotide
ugcuuguuuuuguuuugauuuccccag

SEQ ID NO: 1312 - DNA, 27 bp, Artificial Sequence
  Description of Artificial Sequence: Synthetic oligonucleotide
cggtgaagtttttaaaagctgctaaag

SEQ ID NO: 1313 - DNA, 27 bp, Artificial Sequence
  Description of Artificial Sequence: Synthetic oligonucleotide
gtttttaaaagctgctaaagactcgga

SEQ ID NO: 1314 - DNA, 27 bp, Artificial Sequence
  Description of Artificial Sequence: Synthetic oligonucleotide
ttttaaaagctgctaaagactcggagg

SEQ ID NO: 1315 - DNA, 27 bp, Artificial Sequence
  Description of Artificial Sequence: Synthetic oligonucleotide
gcggagagaaccctctgttttccccca

SEQ ID NO: 1316 - DNA, 27 bp, Artificial Sequence
  Description of Artificial Sequence: Synthetic oligonucleotide
agagatcaaaagatgaaaaggcagtca

SEQ ID NO: 1317 - DNA, 27 bp, Artificial Sequence
  Description of Artificial Sequence: Synthetic oligonucleotide
atcaaaagatgaaaaggcagtcaggtc

SEQ ID NO: 1318 - DNA, 27 bp, Artificial Sequence
  Description of Artificial Sequence: Synthetic oligonucleotide
ttcagtagccaaaaaacaaaacaaaca

SEQ ID NO: 1319 - DNA, 27 bp, Artificial Sequence
  Description of Artificial Sequence: Synthetic oligonucleotide
aaaaaacaaaacaaacaaaaacaaaaa

SEQ ID NO: 1320 - DNA, 27 bp, Artificial Sequence
  Description of Artificial Sequence: Synthetic oligonucleotide
aataaaagaaaaagataataactcagt

SEQ ID NO: 1321 - DNA, 27 bp, Artificial Sequence
  Description of Artificial Sequence: Synthetic oligonucleotide
taaaagaaaaagataataactcagttc

SEQ ID NO: 1322 - DNA, 27 bp, Artificial Sequence
  Description of Artificial Sequence: Synthetic oligonucleotide
gaaaaagataataactcagttcttatt

SEQ ID NO: 1323 - DNA, 27 bp, Artificial Sequence
  Description of Artificial Sequence: Synthetic oligonucleotide
taataactcagttcttatttgcaccta

SEQ ID NO: 1324 - DNA, 27 bp, Artificial Sequence
  Description of Artificial Sequence: Synthetic oligonucleotide
ctcagttcttatttgcacctacttcag

SEQ ID NO: 1325 - DNA, 27 bp, Artificial Sequence
  Description of Artificial Sequence: Synthetic oligonucleotide
ggtggaggattttgtttttttctttta

SEQ ID NO: 1326 - DNA, 27 bp, Artificial Sequence
  Description of Artificial Sequence: Synthetic oligonucleotide
tttgtttttttcttttaagatctgggc

SEQ ID NO: 1327 - DNA, 27 bp, Artificial Sequence
  Description of Artificial Sequence: Synthetic oligonucleotide
ttttttcttttaagatctgggcatctt

SEQ ID NO: 1328 - DNA, 27 bp, Artificial Sequence
  Description of Artificial Sequence: Synthetic oligonucleotide
tctgggcatcttttgaatctacccttc

SEQ ID NO: 1329 - DNA, 27 bp, Artificial Sequence
  Description of Artificial Sequence: Synthetic oligonucleotide
cgcaagtttccttctctggagcttccc

SEQ ID NO: 1330 - DNA, 27 bp, Artificial Sequence
  Description of Artificial Sequence: Synthetic oligonucleotide
aagggaagtaggtggaagattcagcca

SEQ ID NO: 1331 - DNA, 27 bp, Artificial Sequence
  Description of Artificial Sequence: Synthetic oligonucleotide
ggaagtaggtggaagattcagccaagc

SEQ ID NO: 1332 - DNA, 27 bp, Artificial Sequence
  Description of Artificial Sequence: Synthetic oligonucleotide
caaggacaattacttagggggcacttc

SEQ ID NO: 1333 - DNA, 27 bp, Artificial Sequence
  Description of Artificial Sequence: Synthetic oligonucleotide
gccgaatgcaaaggttctctgctagac

SEQ ID NO: 1334 - DNA, 27 bp, Artificial Sequence
  Description of Artificial Sequence: Synthetic oligonucleotide
gcaagagcactgaagatactgctgagt

SEQ ID NO: 1335 - DNA, 27 bp, Artificial Sequence
  Description of Artificial Sequence: Synthetic oligonucleotide
ctgaagatactgctgagtattcccctt

SEQ ID NO: 1336 - DNA, 27 bp, Artificial Sequence
  Description of Artificial Sequence: Synthetic oligonucleotide
ttgtgtcaaaagcgaaatgggcccctg

SEQ ID NO: 1337 - DNA, 27 bp, Artificial Sequence
  Description of Artificial Sequence: Synthetic oligonucleotide
tgttttgcccattgactattactttcc

SEQ ID NO: 1338 - DNA, 27 bp, Artificial Sequence
  Description of Artificial Sequence: Synthetic oligonucleotide
cccattgactattactttccaccccag

SEQ ID NO: 1339 - DNA, 27 bp, Artificial Sequence
  Description of Artificial Sequence: Synthetic oligonucleotide
gcaaggtcttcttcaaaagagccgctg

SEQ ID NO: 1340 - DNA, 27 bp, Artificial Sequence
  Description of Artificial Sequence: Synthetic oligonucleotide
tgattgcactattgataaattccgaag

SEQ ID NO: 1341 - DNA, 27 bp, Artificial Sequence
  Description of Artificial Sequence: Synthetic oligonucleotide
tccgaaggaaaaattgtccatcttgtc

SEQ ID NO: 1342 - DNA, 27 bp, Artificial Sequence
  Description of Artificial Sequence: Synthetic oligonucleotide
aggaaaaattgtccatcttgtcgtctt

SEQ ID NO: 1343 - DNA, 27 bp, Artificial Sequence
  Description of Artificial Sequence: Synthetic oligonucleotide
gacagtgtcacacattgaaggctatga

SEQ ID NO: 1344 - DNA, 27 bp, Artificial Sequence
  Description of Artificial Sequence: Synthetic oligonucleotide
attgaaggctatgaatgtcagcccatc

SEQ ID NO: 1345 - DNA, 27 bp, Artificial Sequence
  Description of Artificial Sequence: Synthetic oligonucleotide
agatggctgtcattcagtactcctgga

SEQ ID NO: 1346 - DNA, 27 bp, Artificial Sequence
  Description of Artificial Sequence: Synthetic oligonucleotide
tctggttttcaatgagtaccgcatgca

SEQ ID NO: 1347 - DNA, 27 bp, Artificial Sequence
  Description of Artificial Sequence: Synthetic oligonucleotide
aggaattcctgtgcatgaaagcactgc

SEQ ID NO: 1348 - DNA, 27 bp, Artificial Sequence
  Description of Artificial Sequence: Synthetic oligonucleotide
caaaaattctttgatgaacttcgaatg

SEQ ID NO: 1349 - DNA, 27 bp, Artificial Sequence
  Description of Artificial Sequence: Synthetic oligonucleotide
ctttgatgaacttcgaatgaactacat

SEQ ID NO: 1350 - DNA, 27 bp, Artificial Sequence
  Description of Artificial Sequence: Synthetic oligonucleotide
tgatgaacttcgaatgaactacatcaa

SEQ ID NO: 1351 - DNA, 27 bp, Artificial Sequence
  Description of Artificial Sequence: Synthetic oligonucleotide
cgaatgaactacatcaaggaactcgat

SEQ ID NO: 1352 - DNA, 27 bp, Artificial Sequence
  Description of Artificial Sequence: Synthetic oligonucleotide
aatgaactacatcaaggaactcgatcg

SEQ ID NO: 1353 - DNA, 27 bp, Artificial Sequence
  Description of Artificial Sequence: Synthetic oligonucleotide
gcaaaagaaaaaatcccacatcctgct

SEQ ID NO: 1354 - DNA, 27 bp, Artificial Sequence
  Description of Artificial Sequence: Synthetic oligonucleotide
aagaaaaaatcccacatcctgctcaag

SEQ ID NO: 1355 - DNA, 27 bp, Artificial Sequence
  Description of Artificial Sequence: Synthetic oligonucleotide
cttttgacctgctaatcaagtcacaca

SEQ ID NO: 1356 - DNA, 27 bp, Artificial Sequence
  Description of Artificial Sequence: Synthetic oligonucleotide
gcctgttataactctgcactactcctc

SEQ ID NO: 1357 - DNA, 27 bp, Artificial Sequence
  Description of Artificial Sequence: Synthetic oligonucleotide
ctgttataactctgcactactcctctg

SEQ ID NO: 1358 - DNA, 27 bp, Artificial Sequence
  Description of Artificial Sequence: Synthetic oligonucleotide
ggaatttcctctattgatgtacagtct

SEQ ID NO: 1359 - DNA, 27 bp, Artificial Sequence
  Description of Artificial Sequence: Synthetic oligonucleotide
ctctattgatgtacagtctgtcatgaa

SEQ ID NO: 1360 - DNA, 27 bp, Artificial Sequence
  Description of Artificial Sequence: Synthetic oligonucleotide
tcatgaacatgttcctgaattctattt

SEQ ID NO: 1361 - DNA, 27 bp, Artificial Sequence
  Description of Artificial Sequence: Synthetic oligonucleotide
tcctgaattctatttgctgggcttttt

SEQ ID NO: 1362 - DNA, 27 bp, Artificial Sequence
  Description of Artificial Sequence: Synthetic oligonucleotide
gctttttttttctctttctctcctttc

SEQ ID NO: 1363 - DNA, 27 bp, Artificial Sequence
  Description of Artificial Sequence: Synthetic oligonucleotide
ttttttctctttctctcctttcttttt

SEQ ID NO: 1364 - DNA, 27 bp, Artificial Sequence
  Description of Artificial Sequence: Synthetic oligonucleotide
ctctttctctcctttctttttcttctt

SEQ ID NO: 1365 - DNA, 27 bp, Artificial Sequence
  Description of Artificial Sequence: Synthetic oligonucleotide
ccatggcaccttcagactttgcttccc

SEQ ID NO: 1366 - DNA, 27 bp, Artificial Sequence
  Description of Artificial Sequence: Synthetic oligonucleotide
tgttttgaatggtgttgtatgccttta

SEQ ID NO: 1367 - DNA, 27 bp, Artificial Sequence
  Description of Artificial Sequence: Synthetic oligonucleotide
tggtgttgtatgcctttaaatctgtga

SEQ ID NO: 1368 - DNA, 27 bp, Artificial Sequence
  Description of Artificial Sequence: Synthetic oligonucleotide
ctttaaatctgtgatgatcctcatatg

SEQ ID NO: 1369 - DNA, 27 bp, Artificial Sequence
  Description of Artificial Sequence: Synthetic oligonucleotide
tctgtgatgatcctcatatggcccagt

SEQ ID NO: 1370 - DNA, 27 bp, Artificial Sequence
  Description of Artificial Sequence: Synthetic oligonucleotide
aagttgtgcttgtttacagcactactc

SEQ ID NO: 1371 - DNA, 27 bp, Artificial Sequence
  Description of Artificial Sequence: Synthetic oligonucleotide
acgtttacttatcttatgccacgggaa

SEQ ID NO: 1372 - DNA, 27 bp, Artificial Sequence
  Description of Artificial Sequence: Synthetic oligonucleotide
agtttagagagctaagattatctgggg

SEQ ID NO: 1373 - DNA, 27 bp, Artificial Sequence
  Description of Artificial Sequence: Synthetic oligonucleotide
gctaagattatctggggaaatcaaaac

SEQ ID NO: 1374 - DNA, 27 bp, Artificial Sequence
  Description of Artificial Sequence: Synthetic oligonucleotide
ctggggaaatcaaaacaaaaacaagca

SEQ ID NO: 1375 - RNA, 25 nt, Artificial Sequence
  Description of Artificial Sequence: Synthetic oligonucleotide
gugaaguuuuuaaaagcugcuaaag

SEQ ID NO: 1376 - RNA, 25 nt, Artificial Sequence
  Description of Artificial Sequence: Synthetic oligonucleotide
uuuuaaaagcugcuaaagacucgga

SEQ ID NO: 1377 - RNA, 25 nt, Artificial Sequence
  Description of Artificial Sequence: Synthetic oligonucleotide
uuaaaagcugcuaaagacucggagg

SEQ ID NO: 1378 - RNA, 25 nt, Artificial Sequence
  Description of Artificial Sequence: Synthetic oligonucleotide
ggagagaacccucuguuuuccccca

SEQ ID NO: 1379 - RNA, 25 nt, Artificial Sequence
  Description of Artificial Sequence: Synthetic oligonucleotide
agaucaaaagaugaaaaggcaguca

SEQ ID NO: 1380 - RNA, 25 nt, Artificial Sequence
  Description of Artificial Sequence: Synthetic oligonucleotide
caaaagaugaaaaggcagucagguc

SEQ ID NO: 1381 - RNA, 25 nt, Artificial Sequence
  Description of Artificial Sequence: Synthetic oligonucleotide
caguagccaaaaaacaaaacaaaca

SEQ ID NO: 1382 - RNA, 25 nt, Artificial Sequence
  Description of Artificial Sequence: Synthetic oligonucleotide
aaaacaaaacaaacaaaaacaaaaa

SEQ ID NO: 1383 - RNA, 25 nt, Artificial Sequence
  Description of Artificial Sequence: Synthetic oligonucleotide
uaaaagaaaaagauaauaacucagu

SEQ ID NO: 1384 - RNA, 25 nt, Artificial Sequence
  Description of Artificial Sequence: Synthetic oligonucleotide
aaagaaaaagauaauaacucaguuc

SEQ ID NO: 1385 - RNA, 25 nt, Artificial Sequence
  Description of Artificial Sequence: Synthetic oligonucleotide
aaaagauaauaacucaguucuuauu

SEQ ID NO: 1386 - RNA, 25 nt, Artificial Sequence
  Description of Artificial Sequence: Synthetic oligonucleotide
auaacucaguucuuauuugcaccua

SEQ ID NO: 1387 - RNA, 25 nt, Artificial Sequence
  Description of Artificial Sequence: Synthetic oligonucleotide
caguucuuauuugcaccuacuucag

SEQ ID NO: 1388 - RNA, 25 nt, Artificial Sequence
  Description of Artificial Sequence: Synthetic oligonucleotide
uggaggauuuuguuuuuuucuuuua

SEQ ID NO: 1389 - RNA, 25 nt, Artificial Sequence
  Description of Artificial Sequence: Synthetic oligonucleotide
uguuuuuuucuuuuaagaucugggc

SEQ ID NO: 1390 - RNA, 25 nt, Artificial Sequence
  Description of Artificial Sequence: Synthetic oligonucleotide
uuuucuuuuaagaucugggcaucuu

SEQ ID NO: 1391 - RNA, 25 nt, Artificial Sequence
  Description of Artificial Sequence: Synthetic oligonucleotide
ugggcaucuuuugaaucuacccuuc

SEQ ID NO: 1392 - RNA, 25 nt, Artificial Sequence
  Description of Artificial Sequence: Synthetic oligonucleotide
caaguuuccuucucuggagcuuccc

SEQ ID NO: 1393 - RNA, 25 nt, Artificial Sequence
  Description of Artificial Sequence: Synthetic oligonucleotide
gggaaguagguggaagauucagcca

SEQ ID NO: 1394 - RNA, 25 nt, Artificial Sequence
  Description of Artificial Sequence: Synthetic oligonucleotide
aaguagguggaagauucagccaagc

SEQ ID NO: 1395 - RNA, 25 nt, Artificial Sequence
  Description of Artificial Sequence: Synthetic oligonucleotide
aggacaauuacuuagggggcacuuc

SEQ ID NO: 1396 - RNA, 25 nt, Artificial Sequence
  Description of Artificial Sequence: Synthetic oligonucleotide
cgaaugcaaagguucucugcuagac

SEQ ID NO: 1397 - RNA, 25 nt, Artificial Sequence
  Description of Artificial Sequence: Synthetic oligonucleotide
aagagcacugaagauacugcugagu

SEQ ID NO: 1398 - RNA, 25 nt, Artificial Sequence
  Description of Artificial Sequence: Synthetic oligonucleotide
gaagauacugcugaguauuccccuu

SEQ ID NO: 1399 - RNA, 25 nt, Artificial Sequence
  Description of Artificial Sequence: Synthetic oligonucleotide
gugucaaaagcgaaaugggccccug

SEQ ID NO: 1400 - RNA, 25 nt, Artificial Sequence
  Description of Artificial Sequence: Synthetic oligonucleotide
uuuugcccauugacuauuacuuucc

SEQ ID NO: 1401 - RNA, 25 nt, Artificial Sequence
  Description of Artificial Sequence: Synthetic oligonucleotide
cauugacuauuacuuuccaccccag

SEQ ID NO: 1402 - RNA, 25 nt, Artificial Sequence
  Description of Artificial Sequence: Synthetic oligonucleotide
aaggucuucuucaaaagagccgcug

SEQ ID NO: 1403 - RNA, 25 nt, Artificial Sequence
  Description of Artificial Sequence: Synthetic oligonucleotide
auugcacuauugauaaauuccgaag

SEQ ID NO: 1404 - RNA, 25 nt, Artificial Sequence
  Description of Artificial Sequence: Synthetic oligonucleotide
cgaaggaaaaauuguccaucuuguc

SEQ ID NO: 1405 - RNA, 25 nt, Artificial Sequence
  Description of Artificial Sequence: Synthetic oligonucleotide
gaaaaauuguccaucuugucgucuu

SEQ ID NO: 1406 - RNA, 25 nt, Artificial Sequence
  Description of Artificial Sequence: Synthetic oligonucleotide
cagugucacacauugaaggcuauga

SEQ ID NO: 1407 - RNA, 25 nt, Artificial Sequence
  Description of Artificial Sequence: Synthetic oligonucleotide
ugaaggcuaugaaugucagcccauc

SEQ ID NO: 1408 - RNA, 25 nt, Artificial Sequence
  Description of Artificial Sequence: Synthetic oligonucleotide
auggcugucauucaguacuccugga

SEQ ID NO: 1409 - RNA, 25 nt, Artificial Sequence
  Description of Artificial Sequence: Synthetic oligonucleotide
ugguuuucaaugaguaccgcaugca

SEQ ID NO: 1410 - RNA, 25 nt, Artificial Sequence
  Description of Artificial Sequence: Synthetic oligonucleotide
gaauuccugugcaugaaagcacugc

SEQ ID NO: 1411 - RNA, 25 nt, Artificial Sequence
  Description of Artificial Sequence: Synthetic oligonucleotide
aaaauucuuugaugaacuucgaaug

SEQ ID NO: 1412 - RNA, 25 nt, Artificial Sequence
  Description of Artificial Sequence: Synthetic oligonucleotide
uugaugaacuucgaaugaacuacau

SEQ ID NO: 1413 - RNA, 25 nt, Artificial Sequence
  Description of Artificial Sequence: Synthetic oligonucleotide
augaacuucgaaugaacuacaucaa

SEQ ID NO: 1414 - RNA, 25 nt, Artificial Sequence
  Description of Artificial Sequence: Synthetic oligonucleotide
aaugaacuacaucaaggaacucgau

SEQ ID NO: 1415 - RNA, 25 nt, Artificial Sequence
  Description of Artificial Sequence: Synthetic oligonucleotide
ugaacuacaucaaggaacucgaucg

SEQ ID NO: 1416 - RNA, 25 nt, Artificial Sequence
  Description of Artificial Sequence: Synthetic oligonucleotide
aaaagaaaaaaucccacauccugcu

SEQ ID NO: 1417 - RNA, 25 nt, Artificial Sequence
  Description of Artificial Sequence: Synthetic oligonucleotide
gaaaaaaucccacauccugcucaag

SEQ ID NO: 1418 - RNA, 25 nt, Artificial Sequence
  Description of Artificial Sequence: Synthetic oligonucleotide
uuugaccugcuaaucaagucacaca

SEQ ID NO: 1419 - RNA, 25 nt, Artificial Sequence
  Description of Artificial Sequence: Synthetic oligonucleotide
cuguuauaacucugcacuacuccuc

SEQ ID NO: 1420 - RNA, 25 nt, Artificial Sequence
  Description of Artificial Sequence: Synthetic oligonucleotide
guuauaacucugcacuacuccucug

SEQ ID NO: 1421 - RNA, 25 nt, Artificial Sequence
  Description of Artificial Sequence: Synthetic oligonucleotide
aauuuccucuauugauguacagucu

SEQ ID NO: 1422 - RNA, 25 nt, Artificial Sequence
  Description of Artificial Sequence: Synthetic oligonucleotide
cuauugauguacagucugucaugaa

SEQ ID NO: 1423 - RNA, 25 nt, Artificial Sequence
  Description of Artificial Sequence: Synthetic oligonucleotide
augaacauguuccugaauucuauuu

SEQ ID NO: 1424 - RNA, 25 nt, Artificial Sequence
  Description of Artificial Sequence: Synthetic oligonucleotide
cugaauucuauuugcugggcuuuuu

SEQ ID NO: 1425 - RNA, 25 nt, Artificial Sequence
  Description of Artificial Sequence: Synthetic oligonucleotide
uuuuuuuuucucuuucucuccuuuc

SEQ ID NO: 1426 - RNA, 25 nt, Artificial Sequence
  Description of Artificial Sequence: Synthetic oligonucleotide
uuuucucuuucucuccuuucuuuuu

SEQ ID NO: 1427 - RNA, 25 nt, Artificial Sequence
  Description of Artificial Sequence: Synthetic oligonucleotide
cuuucucuccuuucuuuuucuucuu

SEQ ID NO: 1428 - RNA, 25 nt, Artificial Sequence
  Description of Artificial Sequence: Synthetic oligonucleotide
auggcaccuucagacuuugcuuccc

SEQ ID NO: 1429 - RNA, 25 nt, Artificial Sequence
  Description of Artificial Sequence: Synthetic oligonucleotide
uuuugaaugguguuguaugccuuua

SEQ ID NO: 1430 - RNA, 25 nt, Artificial Sequence
  Description of Artificial Sequence: Synthetic oligonucleotide
guguuguaugccuuuaaaucuguga

SEQ ID NO: 1431 - RNA, 25 nt, Artificial Sequence
  Description of Artificial Sequence: Synthetic oligonucleotide
uuaaaucugugaugauccucauaug

SEQ ID NO: 1432 - RNA, 25 nt, Artificial Sequence
  Description of Artificial Sequence: Synthetic oligonucleotide
ugugaugauccucauauggcccagu

SEQ ID NO: 1433 - RNA, 25 nt, Artificial Sequence
  Description of Artificial Sequence: Synthetic oligonucleotide
guugugcuuguuuacagcacuacuc

SEQ ID NO: 1434 - RNA, 25 nt, Artificial Sequence
  Description of Artificial Sequence: Synthetic oligonucleotide
guuuacuuaucuuaugccacgggaa

SEQ ID NO: 1435 - RNA, 25 nt, Artificial Sequence
  Description of Artificial Sequence: Synthetic oligonucleotide
uuuagagagcuaagauuaucugggg

SEQ ID NO: 1436 - RNA, 25 nt, Artificial Sequence
  Description of Artificial Sequence: Synthetic oligonucleotide
uaagauuaucuggggaaaucaaaac

SEQ ID NO: 1437 - RNA, 25 nt, Artificial Sequence
  Description of Artificial Sequence: Synthetic oligonucleotide
ggggaaaucaaaacaaaaacaagca

SEQ ID NO: 1438 - DNA, 21 bp, Artificial Sequence
  Description of Artificial Sequence: Synthetic oligonucleotide
cggtgaagtttttaaaagctg

SEQ ID NO: 1439 - DNA, 21 bp, Artificial Sequence
  Description of Artificial Sequence: Synthetic oligonucleotide
gtttttaaaagctgctaaaga

SEQ ID NO: 1440 - DNA, 21 bp, Artificial Sequence
  Description of Artificial Sequence: Synthetic oligonucleotide
ttttaaaagctgctaaagact

SEQ ID NO: 1441 - DNA, 21 bp, Artificial Sequence
  Description of Artificial Sequence: Synthetic oligonucleotide
gcggagagaaccctctgtttt

SEQ ID NO: 1442 - DNA, 21 bp, Artificial Sequence
  Description of Artificial Sequence: Synthetic oligonucleotide
agagatcaaaagatgaaaagg

SEQ ID NO: 1443 - DNA, 21 bp, Artificial Sequence
  Description of Artificial Sequence: Synthetic oligonucleotide
atcaaaagatgaaaaggcagt

SEQ ID NO: 1444 - DNA, 21 bp, Artificial Sequence
  Description of Artificial Sequence: Synthetic oligonucleotide
ttcagtagccaaaaaacaaaa

SEQ ID NO: 1445 - DNA, 21 bp, Artificial Sequence
  Description of Artificial Sequence: Synthetic oligonucleotide
aaaaaacaaaacaaacaaaaa

SEQ ID NO: 1446 - DNA, 21 bp, Artificial Sequence
  Description of Artificial Sequence: Synthetic oligonucleotide
aataaaagaaaaagataataa

SEQ ID NO: 1447 - DNA, 21 bp, Artificial Sequence
  Description of Artificial Sequence: Synthetic oligonucleotide
taaaagaaaaagataataact

SEQ ID NO: 1448 - DNA, 21 bp, Artificial Sequence
  Description of Artificial Sequence: Synthetic oligonucleotide
gaaaaagataataactcagtt

SEQ ID NO: 1449 - DNA, 21 bp, Artificial Sequence
  Description of Artificial Sequence: Synthetic oligonucleotide
taataactcagttcttatttg

SEQ ID NO: 1450 - DNA, 21 bp, Artificial Sequence
  Description of Artificial Sequence: Synthetic oligonucleotide
ctcagttcttatttgcaccta

SEQ ID NO: 1451 - DNA, 21 bp, Artificial Sequence
  Description of Artificial Sequence: Synthetic oligonucleotide
ggtggaggattttgttttttt

SEQ ID NO: 1452 - DNA, 21 bp, Artificial Sequence
  Description of Artificial Sequence: Synthetic oligonucleotide
tttgtttttttcttttaagat

SEQ ID NO: 1453 - DNA, 21 bp, Artificial Sequence
  Description of Artificial Sequence: Synthetic oligonucleotide
ttttttcttttaagatctggg

SEQ ID NO: 1454 - DNA, 21 bp, Artificial Sequence
  Description of Artificial Sequence: Synthetic oligonucleotide
tctgggcatcttttgaatcta

SEQ ID NO: 1455 - DNA, 21 bp, Artificial Sequence
  Description of Artificial Sequence: Synthetic oligonucleotide
cgcaagtttccttctctggag

SEQ ID NO: 1456 - DNA, 21 bp, Artificial Sequence
  Description of Artificial Sequence: Synthetic oligonucleotide
aagggaagtaggtggaagatt

SEQ ID NO: 1457 - DNA, 21 bp, Artificial Sequence
  Description of Artificial Sequence: Synthetic oligonucleotide
ggaagtaggtggaagattcag

SEQ ID NO: 1458 - DNA, 21 bp, Artificial Sequence
  Description of Artificial Sequence: Synthetic oligonucleotide
caaggacaattacttaggggg

SEQ ID NO: 1459 - DNA, 21 bp, Artificial Sequence
  Description of Artificial Sequence: Synthetic oligonucleotide
gccgaatgcaaaggttctctg

SEQ ID NO: 1460 - DNA, 21 bp, Artificial Sequence
  Description of Artificial Sequence: Synthetic oligonucleotide
gcaagagcactgaagatactg

SEQ ID NO: 1461 - DNA, 21 bp, Artificial Sequence
  Description of Artificial Sequence: Synthetic oligonucleotide
ctgaagatactgctgagtatt

SEQ ID NO: 1462 - DNA, 21 bp, Artificial Sequence
  Description of Artificial Sequence: Synthetic oligonucleotide
ttgtgtcaaaagcgaaatggg

SEQ ID NO: 1463 - DNA, 21 bp, Artificial Sequence
  Description of Artificial Sequence: Synthetic oligonucleotide
tgttttgcccattgactatta

SEQ ID NO: 1464 - DNA, 21 bp, Artificial Sequence
  Description of Artificial Sequence: Synthetic oligonucleotide
cccattgactattactttcca

SEQ ID NO: 1465 - DNA, 21 bp, Artificial Sequence
  Description of Artificial Sequence: Synthetic oligonucleotide
gcaaggtcttcttcaaaagag

SEQ ID NO: 1466 - DNA, 21 bp, Artificial Sequence
  Description of Artificial Sequence: Synthetic oligonucleotide
tgattgcactattgataaatt

SEQ ID NO: 1467 - DNA, 21 bp, Artificial Sequence
  Description of Artificial Sequence: Synthetic oligonucleotide
tccgaaggaaaaattgtccat

SEQ ID NO: 1468 - DNA, 21 bp, Artificial Sequence
  Description of Artificial Sequence: Synthetic oligonucleotide
aggaaaaattgtccatcttgt

SEQ ID NO: 1469 - DNA, 21 bp, Artificial Sequence
  Description of Artificial Sequence: Synthetic oligonucleotide
gacagtgtcacacattgaagg

SEQ ID NO: 1470 - DNA, 21 bp, Artificial Sequence
  Description of Artificial Sequence: Synthetic oligonucleotide
attgaaggctatgaatgtcag

SEQ ID NO: 1471 - DNA, 21 bp, Artificial Sequence
  Description of Artificial Sequence: Synthetic oligonucleotide
agatggctgtcattcagtact

SEQ ID NO: 1472 - DNA, 21 bp, Artificial Sequence
  Description of Artificial Sequence: Synthetic oligonucleotide
tctggttttcaatgagtaccg

SEQ ID NO: 1473 - DNA, 21 bp, Artificial Sequence
  Description of Artificial Sequence: Synthetic oligonucleotide
aggaattcctgtgcatgaaag

SEQ ID NO: 1474 - DNA, 21 bp, Artificial Sequence
  Description of Artificial Sequence: Synthetic oligonucleotide
caaaaattctttgatgaactt

SEQ ID NO: 1475 - DNA, 21 bp, Artificial Sequence
  Description of Artificial Sequence: Synthetic oligonucleotide
ctttgatgaacttcgaatgaa

SEQ ID NO: 1476 - DNA, 21 bp, Artificial Sequence
  Description of Artificial Sequence: Synthetic oligonucleotide
tgatgaacttcgaatgaacta

SEQ ID NO: 1477 - DNA, 21 bp, Artificial Sequence
  Description of Artificial Sequence: Synthetic oligonucleotide
cgaatgaactacatcaaggaa

SEQ ID NO: 1478 - DNA, 21 bp, Artificial Sequence
  Description of Artificial Sequence: Synthetic oligonucleotide
aatgaactacatcaaggaact

SEQ ID NO: 1479 - DNA, 21 bp, Artificial Sequence
  Description of Artificial Sequence: Synthetic oligonucleotide
gcaaaagaaaaaatcccacat

SEQ ID NO: 1480 - DNA, 21 bp, Artificial Sequence
  Description of Artificial Sequence: Synthetic oligonucleotide
aagaaaaaatcccacatcctg

SEQ ID NO: 1481 - DNA, 21 bp, Artificial Sequence
  Description of Artificial Sequence: Synthetic oligonucleotide
cttttgacctgctaatcaagt

SEQ ID NO: 1482 - DNA, 21 bp, Artificial Sequence
  Description of Artificial Sequence: Synthetic oligonucleotide
gcctgttataactctgcacta

SEQ ID NO: 1483 - DNA, 21 bp, Artificial Sequence
  Description of Artificial Sequence: Synthetic oligonucleotide
ctgttataactctgcactact

SEQ ID NO: 1484 - DNA, 21 bp, Artificial Sequence
  Description of Artificial Sequence: Synthetic oligonucleotide
ggaatttcctctattgatgta

SEQ ID NO: 1485 - DNA, 21 bp, Artificial Sequence
  Description of Artificial Sequence: Synthetic oligonucleotide
ctctattgatgtacagtctgt

SEQ ID NO: 1486 - DNA, 21 bp, Artificial Sequence
  Description of Artificial Sequence: Synthetic oligonucleotide
tcatgaacatgttcctgaatt

SEQ ID NO: 1487 - DNA, 21 bp, Artificial Sequence
  Description of Artificial Sequence: Synthetic oligonucleotide
tcctgaattctatttgctggg

SEQ ID NO: 1488 - DNA, 21 bp, Artificial Sequence
  Description of Artificial Sequence: Synthetic oligonucleotide
gctttttttttctctttctct

SEQ ID NO: 1489 - DNA, 21 bp, Artificial Sequence
  Description of Artificial Sequence: Synthetic oligonucleotide
ttttttctctttctctccttt

SEQ ID NO: 1490 - DNA, 21 bp, Artificial Sequence
  Description of Artificial Sequence: Synthetic oligonucleotide
ctctttctctcctttcttttt

SEQ ID NO: 1491 - DNA, 21 bp, Artificial Sequence
  Description of Artificial Sequence: Synthetic oligonucleotide
ccatggcaccttcagactttg

SEQ ID NO: 1492 - DNA, 21 bp, Artificial Sequence
  Description of Artificial Sequence: Synthetic oligonucleotide
tgttttgaatggtgttgtatg

SEQ ID NO: 1493 - DNA, 21 bp, Artificial Sequence
  Description of Artificial Sequence: Synthetic oligonucleotide
tggtgttgtatgcctttaaat

SEQ ID NO: 1494 - DNA, 21 bp, Artificial Sequence
  Description of Artificial Sequence: Synthetic oligonucleotide
ctttaaatctgtgatgatcct

SEQ ID NO: 1495 - DNA, 21 bp, Artificial Sequence
  Description of Artificial Sequence: Synthetic oligonucleotide
tctgtgatgatcctcatatgg

SEQ ID NO: 1496 - DNA, 21 bp, Artificial Sequence
  Description of Artificial Sequence: Synthetic oligonucleotide
aagttgtgcttgtttacagca

SEQ ID NO: 1497 - DNA, 21 bp, Artificial Sequence
  Description of Artificial Sequence: Synthetic oligonucleotide
acgtttacttatcttatgcca

SEQ ID NO: 1498 - DNA, 21 bp, Artificial Sequence
  Description of Artificial Sequence: Synthetic oligonucleotide
agtttagagagctaagattat

SEQ ID NO: 1499 - DNA, 21 bp, Artificial Sequence
  Description of Artificial Sequence: Synthetic oligonucleotide
gctaagattatctggggaaat

SEQ ID NO: 1500 - DNA, 21 bp, Artificial Sequence
  Description of Artificial Sequence: Synthetic oligonucleotide
ctggggaaatcaaaacaaaaa

SEQ ID NO: 1501 - DNA, 25 bp, Artificial Sequence
  Description of Artificial Sequence: Synthetic oligonucleotide
  Description of Combined DNA/RNA Molecule: Synthetic oligonucleotide
gccagcuugcugggagagcgggacg

SEQ ID NO: 1502 - DNA, 25 bp, Artificial Sequence
  Description of Artificial Sequence: Synthetic oligonucleotide
  Description of Combined DNA/RNA Molecule: Synthetic oligonucleotide
gcuccagcgacagccaacgccuctt

SEQ ID NO: 1503 - DNA, 25 bp, Artificial Sequence
  Description of Artificial Sequence: Synthetic oligonucleotide
  Description of Combined DNA/RNA Molecule: Synthetic oligonucleotide
gccaacgccucuugcagcgcggcgg

SEQ ID NO: 1504 - DNA, 25 bp, Artificial Sequence
  Description of Artificial Sequence: Synthetic oligonucleotide
  Description of Combined DNA/RNA Molecule: Synthetic oligonucleotide
cucuugcagcgcggcggcuucgaag

SEQ ID NO: 1505 - DNA, 25 bp, Artificial Sequence
  Description of Artificial Sequence: Synthetic oligonucleotide
  Description of Combined DNA/RNA Molecule: Synthetic oligonucleotide
cagcgcggcggcuucgaagccgccg

SEQ ID NO: 1506 - DNA, 25 bp, Artificial Sequence
  Description of Artificial Sequence: Synthetic oligonucleotide
  Description of Combined DNA/RNA Molecule: Synthetic oligonucleotide
aagccgccgcccggagcugcccutt

SEQ ID NO: 1507 - DNA, 25 bp, Artificial Sequence
  Description of Artificial Sequence: Synthetic oligonucleotide
  Description of Combined DNA/RNA Molecule: Synthetic oligonucleotide
ccgcccggagcugcccuuuccuctt

SEQ ID NO: 1508 - DNA, 25 bp, Artificial Sequence
  Description of Artificial Sequence: Synthetic oligonucleotide
  Description of Combined DNA/RNA Molecule: Synthetic oligonucleotide
aaguuuuuaaaagcugcuaaagact

SEQ ID NO: 1509 - DNA, 25 bp, Artificial Sequence
  Description of Artificial Sequence: Synthetic oligonucleotide
  Description of Combined DNA/RNA Molecule: Synthetic oligonucleotide
gucuucucucccgcagcugccucag

SEQ ID NO: 1510 - DNA, 25 bp, Artificial Sequence
  Description of Artificial Sequence: Synthetic oligonucleotide
  Description of Combined DNA/RNA Molecule: Synthetic oligonucleotide
gcagcugccucagucggcuacuctc

SEQ ID NO: 1511 - DNA, 25 bp, Artificial Sequence
  Description of Artificial Sequence: Synthetic oligonucleotide
  Description of Combined DNA/RNA Molecule: Synthetic oligonucleotide
uggcugcgagcgggcgagcuagctg

SEQ ID NO: 1512 - DNA, 25 bp, Artificial Sequence
  Description of Artificial Sequence: Synthetic oligonucleotide
  Description of Combined DNA/RNA Molecule: Synthetic oligonucleotide
ggcgagcuagcugcacauugcaaag

SEQ ID NO: 1513 - DNA, 25 bp, Artificial Sequence
  Description of Artificial Sequence: Synthetic oligonucleotide
  Description of Combined DNA/RNA Molecule: Synthetic oligonucleotide
ucucuccaccuccuccugccuuccc

SEQ ID NO: 1514 - DNA, 25 bp, Artificial Sequence
  Description of Artificial Sequence: Synthetic oligonucleotide
  Description of Combined DNA/RNA Molecule: Synthetic oligonucleotide
agagaucaaaagaugaaaaggcagt

SEQ ID NO: 1515 - DNA, 25 bp, Artificial Sequence
  Description of Artificial Sequence: Synthetic oligonucleotide
  Description of Combined DNA/RNA Molecule: Synthetic oligonucleotide
guagccaaaaaacaaaacaaacaaa

SEQ ID NO: 1516 - DNA, 25 bp, Artificial Sequence
  Description of Artificial Sequence: Synthetic oligonucleotide
  Description of Combined DNA/RNA Molecule: Synthetic oligonucleotide
aaaaaacaaaacaaacaaaaacaaa

SEQ ID NO: 1517 - DNA, 25 bp, Artificial Sequence
  Description of Artificial Sequence: Synthetic oligonucleotide
  Description of Combined DNA/RNA Molecule: Synthetic oligonucleotide
aaaacaaacaaaaacaaaaaagccg

SEQ ID NO: 1518 - DNA, 25 bp, Artificial Sequence
  Description of Artificial Sequence: Synthetic oligonucleotide
  Description of Combined DNA/RNA Molecule: Synthetic oligonucleotide
aaaaaagccgaaauaaaagaaaaag

SEQ ID NO: 1519 - DNA, 25 bp, Artificial Sequence
  Description of Artificial Sequence: Synthetic oligonucleotide
  Description of Combined DNA/RNA Molecule: Synthetic oligonucleotide
cgaaauaaaagaaaaagauaauaac

SEQ ID NO: 1520 - DNA, 25 bp, Artificial Sequence
  Description of Artificial Sequence: Synthetic oligonucleotide
  Description of Combined DNA/RNA Molecule: Synthetic oligonucleotide
gaaaaagauaauaacucaguucuta

SEQ ID NO: 1521 - DNA, 25 bp, Artificial Sequence
  Description of Artificial Sequence: Synthetic oligonucleotide
  Description of Combined DNA/RNA Molecule: Synthetic oligonucleotide
agauaauaacucaguucuuauuugc

SEQ ID NO: 1522 - DNA, 25 bp, Artificial Sequence
  Description of Artificial Sequence: Synthetic oligonucleotide
  Description of Combined DNA/RNA Molecule: Synthetic oligonucleotide
uaauaacucaguucuuauuugcacc

SEQ ID NO: 1523 - DNA, 25 bp, Artificial Sequence
  Description of Artificial Sequence: Synthetic oligonucleotide
  Description of Combined DNA/RNA Molecule: Synthetic oligonucleotide
gaggauuuuguuuuuuucuuuuaag

SEQ ID NO: 1524 - DNA, 25 bp, Artificial Sequence
  Description of Artificial Sequence: Synthetic oligonucleotide
  Description of Combined DNA/RNA Molecule: Synthetic oligonucleotide
uuuuguuuuuuucuuuuaagauctg

SEQ ID NO: 1525 - DNA, 25 bp, Artificial Sequence
  Description of Artificial Sequence: Synthetic oligonucleotide
  Description of Combined DNA/RNA Molecule: Synthetic oligonucleotide
uuuuuucuuuuaagaucugggcatc

SEQ ID NO: 1526 - DNA, 25 bp, Artificial Sequence
  Description of Artificial Sequence: Synthetic oligonucleotide
  Description of Combined DNA/RNA Molecule: Synthetic oligonucleotide
gcaucuuuugaaucuacccuucaag

SEQ ID NO: 1527 - DNA, 25 bp, Artificial Sequence
  Description of Artificial Sequence: Synthetic oligonucleotide
  Description of Combined DNA/RNA Molecule: Synthetic oligonucleotide
gagcgcuuuuugcgugguugcuccc

SEQ ID NO: 1528 - DNA, 25 bp, Artificial Sequence
  Description of Artificial Sequence: Synthetic oligonucleotide
  Description of Combined DNA/RNA Molecule: Synthetic oligonucleotide
cuuuuugcgugguugcucccgcaag

SEQ ID NO: 1529 - DNA, 25 bp, Artificial Sequence
  Description of Artificial Sequence: Synthetic oligonucleotide
  Description of Combined DNA/RNA Molecule: Synthetic oligonucleotide
guuuccuucucuggagcuucccgca

SEQ ID NO: 1530 - DNA, 25 bp, Artificial Sequence
  Description of Artificial Sequence: Synthetic oligonucleotide
  Description of Combined DNA/RNA Molecule: Synthetic oligonucleotide
cuucccgcaggugggcagcuagctg

SEQ ID NO: 1531 - DNA, 25 bp, Artificial Sequence
  Description of Artificial Sequence: Synthetic oligonucleotide
  Description of Combined DNA/RNA Molecule: Synthetic oligonucleotide
gggcagcuagcugcagcgacuaccg

SEQ ID NO: 1532 - DNA, 25 bp, Artificial Sequence
  Description of Artificial Sequence: Synthetic oligonucleotide
  Description of Combined DNA/RNA Molecule: Synthetic oligonucleotide
gugcaguuagggcugggaaggguct

SEQ ID NO: 1533 - DNA, 25 bp, Artificial Sequence
  Description of Artificial Sequence: Synthetic oligonucleotide
  Description of Combined DNA/RNA Molecule: Synthetic oligonucleotide
ugcaguuagggcugggaagggucta

SEQ ID NO: 1534 - DNA, 25 bp, Artificial Sequence
  Description of Artificial Sequence: Synthetic oligonucleotide
  Description of Combined DNA/RNA Molecule: Synthetic oligonucleotide
gcaguuagggcugggaagggucuac

SEQ ID NO: 1535 - DNA, 25 bp, Artificial Sequence
  Description of Artificial Sequence: Synthetic oligonucleotide
  Description of Combined DNA/RNA Molecule: Synthetic oligonucleotide
caguuagggcugggaagggucuacc

SEQ ID NO: 1536 - DNA, 25 bp, Artificial Sequence
  Description of Artificial Sequence: Synthetic oligonucleotide
  Description of Combined DNA/RNA Molecule: Synthetic oligonucleotide
aguuagggcugggaagggucuaccc

SEQ ID NO: 1537 - DNA, 25 bp, Artificial Sequence
  Description of Artificial Sequence: Synthetic oligonucleotide
  Description of Combined DNA/RNA Molecule: Synthetic oligonucleotide
guuagggcugggaagggucuaccct

SEQ ID NO: 1538 - DNA, 25 bp, Artificial Sequence
  Description of Artificial Sequence: Synthetic oligonucleotide
  Description of Combined DNA/RNA Molecule: Synthetic oligonucleotide
uuagggcugggaagggucuaccctc

SEQ ID NO: 1539 - DNA, 25 bp, Artificial Sequence
  Description of Artificial Sequence: Synthetic oligonucleotide
  Description of Combined DNA/RNA Molecule: Synthetic oligonucleotide
uagggcugggaagggucuacccucg

SEQ ID NO: 1540 - DNA, 25 bp, Artificial Sequence
  Description of Artificial Sequence: Synthetic oligonucleotide
  Description of Combined DNA/RNA Molecule: Synthetic oligonucleotide
agggcugggaagggucuacccucgg

SEQ ID NO: 1541 - DNA, 25 bp, Artificial Sequence
  Description of Artificial Sequence: Synthetic oligonucleotide
  Description of Combined DNA/RNA Molecule: Synthetic oligonucleotide
gggcugggaagggucuacccucggc

SEQ ID NO: 1542 - DNA, 25 bp, Artificial Sequence
  Description of Artificial Sequence: Synthetic oligonucleotide
  Description of Combined DNA/RNA Molecule: Synthetic oligonucleotide
ggcugggaagggucuacccucggcc

SEQ ID NO: 1543 - DNA, 25 bp, Artificial Sequence
  Description of Artificial Sequence: Synthetic oligonucleotide
  Description of Combined DNA/RNA Molecule: Synthetic oligonucleotide
uuccagaaucuguuccagagcgugc

SEQ ID NO: 1544 - DNA, 25 bp, Artificial Sequence
  Description of Artificial Sequence: Synthetic oligonucleotide
  Description of Combined DNA/RNA Molecule: Synthetic oligonucleotide
uccagaaucuguuccagagcgugcg

SEQ ID NO: 1545 - DNA, 25 bp, Artificial Sequence
  Description of Artificial Sequence: Synthetic oligonucleotide
  Description of Combined DNA/RNA Molecule: Synthetic oligonucleotide
ccagaaucuguuccagagcgugcgc

SEQ ID NO: 1546 - DNA, 25 bp, Artificial Sequence
  Description of Artificial Sequence: Synthetic oligonucleotide
  Description of Combined DNA/RNA Molecule: Synthetic oligonucleotide
cagaaucuguuccagagcgugcgcg

SEQ ID NO: 1547 - DNA, 25 bp, Artificial Sequence
  Description of Artificial Sequence: Synthetic oligonucleotide
  Description of Combined DNA/RNA Molecule: Synthetic oligonucleotide
agaaucuguuccagagcgugcgcga

SEQ ID NO: 1548 - DNA, 25 bp, Artificial Sequence
  Description of Artificial Sequence: Synthetic oligonucleotide
  Description of Combined DNA/RNA Molecule: Synthetic oligonucleotide
gaaucuguuccagagcgugcgcgaa

SEQ ID NO: 1549 - DNA, 25 bp, Artificial Sequence
  Description of Artificial Sequence: Synthetic oligonucleotide
  Description of Combined DNA/RNA Molecule: Synthetic oligonucleotide
aaucuguuccagagcgugcgcgaag

SEQ ID NO: 1550 - DNA, 25 bp, Artificial Sequence
  Description of Artificial Sequence: Synthetic oligonucleotide
  Description of Combined DNA/RNA Molecule: Synthetic oligonucleotide
aucuguuccagagcgugcgcgaagt

SEQ ID NO: 1551 - DNA, 25 bp, Artificial Sequence
  Description of Artificial Sequence: Synthetic oligonucleotide
  Description of Combined DNA/RNA Molecule: Synthetic oligonucleotide
ucuguuccagagcgugcgcgaagtg

SEQ ID NO: 1552 - DNA, 25 bp, Artificial Sequence
  Description of Artificial Sequence: Synthetic oligonucleotide
  Description of Combined DNA/RNA Molecule: Synthetic oligonucleotide
cuguuccagagcgugcgcgaaguga

SEQ ID NO: 1553 - DNA, 25 bp, Artificial Sequence
  Description of Artificial Sequence: Synthetic oligonucleotide
  Description of Combined DNA/RNA Molecule: Synthetic oligonucleotide
uguuccagagcgugcgcgaagugat

SEQ ID NO: 1554 - DNA, 25 bp, Artificial Sequence
  Description of Artificial Sequence: Synthetic oligonucleotide
  Description of Combined DNA/RNA Molecule: Synthetic oligonucleotide
guuccagagcgugcgcgaagugatc

SEQ ID NO: 1555 - DNA, 25 bp, Artificial Sequence
  Description of Artificial Sequence: Synthetic oligonucleotide
  Description of Combined DNA/RNA Molecule: Synthetic oligonucleotide
uuccagagcgugcgcgaagugaucc

SEQ ID NO: 1556 - DNA, 25 bp, Artificial Sequence
  Description of Artificial Sequence: Synthetic oligonucleotide
  Description of Combined DNA/RNA Molecule: Synthetic oligonucleotide
cgccaguuugcugcugcugcagcag

SEQ ID NO: 1557 - DNA, 25 bp, Artificial Sequence
  Description of Artificial Sequence: Synthetic oligonucleotide
  Description of Combined DNA/RNA Molecule: Synthetic oligonucleotide
gcugcugcugcagcagcagcagcag

SEQ ID NO: 1558 - DNA, 25 bp, Artificial Sequence
  Description of Artificial Sequence: Synthetic oligonucleotide
  Description of Combined DNA/RNA Molecule: Synthetic oligonucleotide
gucccagagccuggagccgccgugg

SEQ ID NO: 1559 - DNA, 25 bp, Artificial Sequence
  Description of Artificial Sequence: Synthetic oligonucleotide
  Description of Combined DNA/RNA Molecule: Synthetic oligonucleotide
cugccgcagcagcugccagcacctc

SEQ ID NO: 1560 - DNA, 25 bp, Artificial Sequence
  Description of Artificial Sequence: Synthetic oligonucleotide
  Description of Combined DNA/RNA Molecule: Synthetic oligonucleotide
cagcagcugccagcaccuccggacg

SEQ ID NO: 1561 - DNA, 25 bp, Artificial Sequence
  Description of Artificial Sequence: Synthetic oligonucleotide
  Description of Combined DNA/RNA Molecule: Synthetic oligonucleotide
cauccacguugucccugcugggccc

SEQ ID NO: 1562 - DNA, 25 bp, Artificial Sequence
  Description of Artificial Sequence: Synthetic oligonucleotide
  Description of Combined DNA/RNA Molecule: Synthetic oligonucleotide
ggcuuaagcagcugcuccgcugacc

SEQ ID NO: 1563 - DNA, 25 bp, Artificial Sequence
  Description of Artificial Sequence: Synthetic oligonucleotide
  Description of Combined DNA/RNA Molecule: Synthetic oligonucleotide
gcuuaagcagcugcuccgcugacct

SEQ ID NO: 1564 - DNA, 25 bp, Artificial Sequence
  Description of Artificial Sequence: Synthetic oligonucleotide
  Description of Combined DNA/RNA Molecule: Synthetic oligonucleotide
agcagcugcuccgcugaccuuaaag

SEQ ID NO: 1565 - DNA, 25 bp, Artificial Sequence
  Description of Artificial Sequence: Synthetic oligonucleotide
  Description of Combined DNA/RNA Molecule: Synthetic oligonucleotide
gcaacuccuucagcaacagcagcag

SEQ ID NO: 1566 - DNA, 25 bp, Artificial Sequence
  Description of Artificial Sequence: Synthetic oligonucleotide
  Description of Combined DNA/RNA Molecule: Synthetic oligonucleotide
cauuucugacaacgccaaggagutg

SEQ ID NO: 1567 - DNA, 25 bp, Artificial Sequence
  Description of Artificial Sequence: Synthetic oligonucleotide
  Description of Combined DNA/RNA Molecule: Synthetic oligonucleotide
acuuuugggaguuccacccgcugtg

SEQ ID NO: 1568 - DNA, 25 bp, Artificial Sequence
  Description of Artificial Sequence: Synthetic oligonucleotide
  Description of Combined DNA/RNA Molecule: Synthetic oligonucleotide
ggcaagagcacugaagauacugctg

SEQ ID NO: 1569 - DNA, 25 bp, Artificial Sequence
  Description of Artificial Sequence: Synthetic oligonucleotide
  Description of Combined DNA/RNA Molecule: Synthetic oligonucleotide
ggcagcgcugcagcagggagcuccg

SEQ ID NO: 1570 - DNA, 25 bp, Artificial Sequence
  Description of Artificial Sequence: Synthetic oligonucleotide
  Description of Combined DNA/RNA Molecule: Synthetic oligonucleotide
ucgcgacuacuacaacuuuccactg

SEQ ID NO: 1571 - DNA, 25 bp, Artificial Sequence
  Description of Artificial Sequence: Synthetic oligonucleotide
  Description of Combined DNA/RNA Molecule: Synthetic oligonucleotide
cgcgacuacuacaacuuuccacugg

SEQ ID NO: 1572 - DNA, 25 bp, Artificial Sequence
  Description of Artificial Sequence: Synthetic oligonucleotide
  Description of Combined DNA/RNA Molecule: Synthetic oligonucleotide
gcgacuacuacaacuuuccacuggc

SEQ ID NO: 1573 - DNA, 25 bp, Artificial Sequence
  Description of Artificial Sequence: Synthetic oligonucleotide
  Description of Combined DNA/RNA Molecule: Synthetic oligonucleotide
ucgcaucaagcuggagaacccgctg

SEQ ID NO: 1574 - DNA, 25 bp, Artificial Sequence
  Description of Artificial Sequence: Synthetic oligonucleotide
  Description of Combined DNA/RNA Molecule: Synthetic oligonucleotide
uggacuacggcagcgccugggcggc

SEQ ID NO: 1575 - DNA, 25 bp, Artificial Sequence
  Description of Artificial Sequence: Synthetic oligonucleotide
  Description of Combined DNA/RNA Molecule: Synthetic oligonucleotide
ggacuacggcagcgccugggcggct

SEQ ID NO: 1576 - DNA, 25 bp, Artificial Sequence
  Description of Artificial Sequence: Synthetic oligonucleotide
  Description of Combined DNA/RNA Molecule: Synthetic oligonucleotide
gacuacggcagcgccugggcggctg

SEQ ID NO: 1577 - DNA, 25 bp, Artificial Sequence
  Description of Artificial Sequence: Synthetic oligonucleotide
  Description of Combined DNA/RNA Molecule: Synthetic oligonucleotide
acuacggcagcgccugggcggcugc

SEQ ID NO: 1578 - DNA, 25 bp, Artificial Sequence
  Description of Artificial Sequence: Synthetic oligonucleotide
  Description of Combined DNA/RNA Molecule: Synthetic oligonucleotide
gcgcgggugcagcgggacccggutc

SEQ ID NO: 1579 - DNA, 25 bp, Artificial Sequence
  Description of Artificial Sequence: Synthetic oligonucleotide
  Description of Combined DNA/RNA Molecule: Synthetic oligonucleotide
cuggcgggccaggaaagcgacuuca

SEQ ID NO: 1580 - DNA, 25 bp, Artificial Sequence
  Description of Artificial Sequence: Synthetic oligonucleotide
  Description of Combined DNA/RNA Molecule: Synthetic oligonucleotide
acccuggcggcauggugagcagagt

SEQ ID NO: 1581 - DNA, 25 bp, Artificial Sequence
  Description of Artificial Sequence: Synthetic oligonucleotide
  Description of Combined DNA/RNA Molecule: Synthetic oligonucleotide
gauggauagcuacuccggaccuuac

SEQ ID NO: 1582 - DNA, 25 bp, Artificial Sequence
  Description of Artificial Sequence: Synthetic oligonucleotide
  Description of Combined DNA/RNA Molecule: Synthetic oligonucleotide
cagaagaccugccugaucuguggag

SEQ ID NO: 1583 - DNA, 25 bp, Artificial Sequence
  Description of Artificial Sequence: Synthetic oligonucleotide
  Description of Combined DNA/RNA Molecule: Synthetic oligonucleotide
agaagaccugccugaucuguggaga

SEQ ID NO: 1584 - DNA, 25 bp, Artificial Sequence
  Description of Artificial Sequence: Synthetic oligonucleotide
  Description of Combined DNA/RNA Molecule: Synthetic oligonucleotide
gaagaccugccugaucuguggagat

SEQ ID NO: 1585 - DNA, 25 bp, Artificial Sequence
  Description of Artificial Sequence: Synthetic oligonucleotide
  Description of Combined DNA/RNA Molecule: Synthetic oligonucleotide
aagaccugccugaucuguggagatg

SEQ ID NO: 1586 - DNA, 25 bp, Artificial Sequence
  Description of Artificial Sequence: Synthetic oligonucleotide
  Description of Combined DNA/RNA Molecule: Synthetic oligonucleotide
agaccugccugaucuguggagauga

SEQ ID NO: 1587 - DNA, 25 bp, Artificial Sequence
  Description of Artificial Sequence: Synthetic oligonucleotide
  Description of Combined DNA/RNA Molecule: Synthetic oligonucleotide
gaccugccugaucuguggagaugaa

SEQ ID NO: 1588 - DNA, 25 bp, Artificial Sequence
  Description of Artificial Sequence: Synthetic oligonucleotide
  Description of Combined DNA/RNA Molecule: Synthetic oligonucleotide
accugccugaucuguggagaugaag

SEQ ID NO: 1589 - DNA, 25 bp, Artificial Sequence
  Description of Artificial Sequence: Synthetic oligonucleotide
  Description of Combined DNA/RNA Molecule: Synthetic oligonucleotide
ccugccugaucuguggagaugaagc

SEQ ID NO: 1590 - DNA, 25 bp, Artificial Sequence
  Description of Artificial Sequence: Synthetic oligonucleotide
  Description of Combined DNA/RNA Molecule: Synthetic oligonucleotide
cugccugaucuguggagaugaagct

SEQ ID NO: 1591 - DNA, 25 bp, Artificial Sequence
  Description of Artificial Sequence: Synthetic oligonucleotide
  Description of Combined DNA/RNA Molecule: Synthetic oligonucleotide
ugccugaucuguggagaugaagctt

SEQ ID NO: 1592 - DNA, 25 bp, Artificial Sequence
  Description of Artificial Sequence: Synthetic oligonucleotide
  Description of Combined DNA/RNA Molecule: Synthetic oligonucleotide
gccugaucuguggagaugaagcutc

SEQ ID NO: 1593 - DNA, 25 bp, Artificial Sequence
  Description of Artificial Sequence: Synthetic oligonucleotide
  Description of Combined DNA/RNA Molecule: Synthetic oligonucleotide
ccugaucuguggagaugaagcuuct

SEQ ID NO: 1594 - DNA, 25 bp, Artificial Sequence
  Description of Artificial Sequence: Synthetic oligonucleotide
  Description of Combined DNA/RNA Molecule: Synthetic oligonucleotide
cugaucuguggagaugaagcuuctg

SEQ ID NO: 1595 - DNA, 25 bp, Artificial Sequence
  Description of Artificial Sequence: Synthetic oligonucleotide
  Description of Combined DNA/RNA Molecule: Synthetic oligonucleotide
ugaucuguggagaugaagcuucugg

SEQ ID NO: 1596 - DNA, 25 bp, Artificial Sequence
  Description of Artificial Sequence: Synthetic oligonucleotide
  Description of Combined DNA/RNA Molecule: Synthetic oligonucleotide
gaucuguggagaugaagcuucuggg

SEQ ID NO: 1597 - DNA, 25 bp, Artificial Sequence
  Description of Artificial Sequence: Synthetic oligonucleotide
  Description of Combined DNA/RNA Molecule: Synthetic oligonucleotide
aucuguggagaugaagcuucugggt

SEQ ID NO: 1598 - DNA, 25 bp, Artificial Sequence
  Description of Artificial Sequence: Synthetic oligonucleotide
  Description of Combined DNA/RNA Molecule: Synthetic oligonucleotide
ucuguggagaugaagcuucugggtg

SEQ ID NO: 1599 - DNA, 25 bp, Artificial Sequence
  Description of Artificial Sequence: Synthetic oligonucleotide
  Description of Combined DNA/RNA Molecule: Synthetic oligonucleotide
cuguggagaugaagcuucugggugt

SEQ ID NO: 1600 - DNA, 25 bp, Artificial Sequence
  Description of Artificial Sequence: Synthetic oligonucleotide
  Description of Combined DNA/RNA Molecule: Synthetic oligonucleotide
uguggagaugaagcuucugggugtc

SEQ ID NO: 1601 - DNA, 25 bp, Artificial Sequence
  Description of Artificial Sequence: Synthetic oligonucleotide
  Description of Combined DNA/RNA Molecule: Synthetic oligonucleotide
guggagaugaagcuucuggguguca

SEQ ID NO: 1602 - DNA, 25 bp, Artificial Sequence
  Description of Artificial Sequence: Synthetic oligonucleotide
  Description of Combined DNA/RNA Molecule: Synthetic oligonucleotide
uucugggugucacuauggagcuctc

SEQ ID NO: 1603 - DNA, 25 bp, Artificial Sequence
  Description of Artificial Sequence: Synthetic oligonucleotide
  Description of Combined DNA/RNA Molecule: Synthetic oligonucleotide
gagcucucacauguggaagcugcaa

SEQ ID NO: 1604 - DNA, 25 bp, Artificial Sequence
  Description of Artificial Sequence: Synthetic oligonucleotide
  Description of Combined DNA/RNA Molecule: Synthetic oligonucleotide
agcugcaaggucuucuucaaaagag

SEQ ID NO: 1605 - DNA, 25 bp, Artificial Sequence
  Description of Artificial Sequence: Synthetic oligonucleotide
  Description of Combined DNA/RNA Molecule: Synthetic oligonucleotide
gcugcaaggucuucuucaaaagagc

SEQ ID NO: 1606 - DNA, 25 bp, Artificial Sequence
  Description of Artificial Sequence: Synthetic oligonucleotide
  Description of Combined DNA/RNA Molecule: Synthetic oligonucleotide
cugcaaggucuucuucaaaagagcc

SEQ ID NO: 1607 - DNA, 25 bp, Artificial Sequence
  Description of Artificial Sequence: Synthetic oligonucleotide
  Description of Combined DNA/RNA Molecule: Synthetic oligonucleotide
ugcaaggucuucuucaaaagagccg

SEQ ID NO: 1608 - DNA, 25 bp, Artificial Sequence
  Description of Artificial Sequence: Synthetic oligonucleotide
  Description of Combined DNA/RNA Molecule: Synthetic oligonucleotide
gcaaggucuucuucaaaagagccgc

SEQ ID NO: 1609 - DNA, 25 bp, Artificial Sequence
  Description of Artificial Sequence: Synthetic oligonucleotide
  Description of Combined DNA/RNA Molecule: Synthetic oligonucleotide
caaggucuucuucaaaagagccgct

SEQ ID NO: 1610 - DNA, 25 bp, Artificial Sequence
  Description of Artificial Sequence: Synthetic oligonucleotide
  Description of Combined DNA/RNA Molecule: Synthetic oligonucleotide
aaggucuucuucaaaagagccgctg

SEQ ID NO: 1611 - DNA, 25 bp, Artificial Sequence
  Description of Artificial Sequence: Synthetic oligonucleotide
  Description of Combined DNA/RNA Molecule: Synthetic oligonucleotide
aggucuucuucaaaagagccgcuga

SEQ ID NO: 1612 - DNA, 25 bp, Artificial Sequence
  Description of Artificial Sequence: Synthetic oligonucleotide
  Description of Combined DNA/RNA Molecule: Synthetic oligonucleotide
ggucuucuucaaaagagccgcugaa

SEQ ID NO: 1613 - DNA, 25 bp, Artificial Sequence
  Description of Artificial Sequence: Synthetic oligonucleotide
  Description of Combined DNA/RNA Molecule: Synthetic oligonucleotide
gucuucuucaaaagagccgcugaag

SEQ ID NO: 1614 - DNA, 25 bp, Artificial Sequence
  Description of Artificial Sequence: Synthetic oligonucleotide
  Description of Combined DNA/RNA Molecule: Synthetic oligonucleotide
ucuucuucaaaagagccgcugaagg

SEQ ID NO: 1615 - DNA, 25 bp, Artificial Sequence
  Description of Artificial Sequence: Synthetic oligonucleotide
  Description of Combined DNA/RNA Molecule: Synthetic oligonucleotide
cuucuucaaaagagccgcugaaggg

SEQ ID NO: 1616 - DNA, 25 bp, Artificial Sequence
  Description of Artificial Sequence: Synthetic oligonucleotide
  Description of Combined DNA/RNA Molecule: Synthetic oligonucleotide
uucuucaaaagagccgcugaaggga

SEQ ID NO: 1617 - DNA, 25 bp, Artificial Sequence
  Description of Artificial Sequence: Synthetic oligonucleotide
  Description of Combined DNA/RNA Molecule: Synthetic oligonucleotide
ucuucaaaagagccgcugaagggaa

SEQ ID NO: 1618 - DNA, 25 bp, Artificial Sequence
  Description of Artificial Sequence: Synthetic oligonucleotide
  Description of Combined DNA/RNA Molecule: Synthetic oligonucleotide
cuucaaaagagccgcugaagggaaa

SEQ ID NO: 1619 - DNA, 25 bp, Artificial Sequence
  Description of Artificial Sequence: Synthetic oligonucleotide
  Description of Combined DNA/RNA Molecule: Synthetic oligonucleotide
uucaaaagagccgcugaagggaaac

SEQ ID NO: 1620 - DNA, 25 bp, Artificial Sequence
  Description of Artificial Sequence: Synthetic oligonucleotide
  Description of Combined DNA/RNA Molecule: Synthetic oligonucleotide
ucaaaagagccgcugaagggaaaca

SEQ ID NO: 1621 - DNA, 25 bp, Artificial Sequence
  Description of Artificial Sequence: Synthetic oligonucleotide
  Description of Combined DNA/RNA Molecule: Synthetic oligonucleotide
caaaagagccgcugaagggaaacag

SEQ ID NO: 1622 - DNA, 25 bp, Artificial Sequence
  Description of Artificial Sequence: Synthetic oligonucleotide
  Description of Combined DNA/RNA Molecule: Synthetic oligonucleotide
aaaagagccgcugaagggaaacaga

SEQ ID NO: 1623 - DNA, 25 bp, Artificial Sequence
  Description of Artificial Sequence: Synthetic oligonucleotide
  Description of Combined DNA/RNA Molecule: Synthetic oligonucleotide
aaagagccgcugaagggaaacagaa

SEQ ID NO: 1624 - DNA, 25 bp, Artificial Sequence
  Description of Artificial Sequence: Synthetic oligonucleotide
  Description of Combined DNA/RNA Molecule: Synthetic oligonucleotide
aagagccgcugaagggaaacagaag

SEQ ID NO: 1625 - DNA, 25 bp, Artificial Sequence
  Description of Artificial Sequence: Synthetic oligonucleotide
  Description of Combined DNA/RNA Molecule: Synthetic oligonucleotide
agagccgcugaagggaaacagaagt

SEQ ID NO: 1626 - DNA, 25 bp, Artificial Sequence
  Description of Artificial Sequence: Synthetic oligonucleotide
  Description of Combined DNA/RNA Molecule: Synthetic oligonucleotide
gagccgcugaagggaaacagaagta

SEQ ID NO: 1627 - DNA, 25 bp, Artificial Sequence
  Description of Artificial Sequence: Synthetic oligonucleotide
  Description of Combined DNA/RNA Molecule: Synthetic oligonucleotide
agccgcugaagggaaacagaaguac

SEQ ID NO: 1628 - DNA, 25 bp, Artificial Sequence
  Description of Artificial Sequence: Synthetic oligonucleotide
  Description of Combined DNA/RNA Molecule: Synthetic oligonucleotide
gccgcugaagggaaacagaaguacc

SEQ ID NO: 1629 - DNA, 25 bp, Artificial Sequence
  Description of Artificial Sequence: Synthetic oligonucleotide
  Description of Combined DNA/RNA Molecule: Synthetic oligonucleotide
ccgcugaagggaaacagaaguacct

SEQ ID NO: 1630 - DNA, 25 bp, Artificial Sequence
  Description of Artificial Sequence: Synthetic oligonucleotide
  Description of Combined DNA/RNA Molecule: Synthetic oligonucleotide
gcugaagggaaacagaaguaccugt

SEQ ID NO: 1631 - DNA, 25 bp, Artificial Sequence
  Description of Artificial Sequence: Synthetic oligonucleotide
  Description of Combined DNA/RNA Molecule: Synthetic oligonucleotide
cugaagggaaacagaaguaccugtg

SEQ ID NO: 1632 - DNA, 25 bp, Artificial Sequence
  Description of Artificial Sequence: Synthetic oligonucleotide
  Description of Combined DNA/RNA Molecule: Synthetic oligonucleotide
ugugcgccagcagaaaugauugcac

SEQ ID NO: 1633 - DNA, 25 bp, Artificial Sequence
  Description of Artificial Sequence: Synthetic oligonucleotide
  Description of Combined DNA/RNA Molecule: Synthetic oligonucleotide
agaaaugauugcacuauugauaaat

SEQ ID NO: 1634 - DNA, 25 bp, Artificial Sequence
  Description of Artificial Sequence: Synthetic oligonucleotide
  Description of Combined DNA/RNA Molecule: Synthetic oligonucleotide
ugauugcacuauugauaaauuccga

SEQ ID NO: 1635 - DNA, 25 bp, Artificial Sequence
  Description of Artificial Sequence: Synthetic oligonucleotide
  Description of Combined DNA/RNA Molecule: Synthetic oligonucleotide
cuauugauaaauuccgaaggaaaaa

SEQ ID NO: 1636 - DNA, 25 bp, Artificial Sequence
  Description of Artificial Sequence: Synthetic oligonucleotide
  Description of Combined DNA/RNA Molecule: Synthetic oligonucleotide
cggaaauguuaugaagcagggauga

SEQ ID NO: 1637 - DNA, 25 bp, Artificial Sequence
  Description of Artificial Sequence: Synthetic oligonucleotide
  Description of Combined DNA/RNA Molecule: Synthetic oligonucleotide
ggaaauguuaugaagcagggaugac

SEQ ID NO: 1638 - DNA, 25 bp, Artificial Sequence
  Description of Artificial Sequence: Synthetic oligonucleotide
  Description of Combined DNA/RNA Molecule: Synthetic oligonucleotide
gaaauguuaugaagcagggaugact

SEQ ID NO: 1639 - DNA, 25 bp, Artificial Sequence
  Description of Artificial Sequence: Synthetic oligonucleotide
  Description of Combined DNA/RNA Molecule: Synthetic oligonucleotide
aaauguuaugaagcagggaugactc

SEQ ID NO: 1640 - DNA, 25 bp, Artificial Sequence
  Description of Artificial Sequence: Synthetic oligonucleotide
  Description of Combined DNA/RNA Molecule: Synthetic oligonucleotide
aauguuaugaagcagggaugacuct

SEQ ID NO: 1641 - DNA, 25 bp, Artificial Sequence
  Description of Artificial Sequence: Synthetic oligonucleotide
  Description of Combined DNA/RNA Molecule: Synthetic oligonucleotide
auguuaugaagcagggaugacuctg

SEQ ID NO: 1642 - DNA, 25 bp, Artificial Sequence
  Description of Artificial Sequence: Synthetic oligonucleotide
  Description of Combined DNA/RNA Molecule: Synthetic oligonucleotide
uguuaugaagcagggaugacucugg

SEQ ID NO: 1643 - DNA, 25 bp, Artificial Sequence
  Description of Artificial Sequence: Synthetic oligonucleotide
  Description of Combined DNA/RNA Molecule: Synthetic oligonucleotide
guuaugaagcagggaugacucuggg

SEQ ID NO: 1644 - DNA, 25 bp, Artificial Sequence
  Description of Artificial Sequence: Synthetic oligonucleotide
  Description of Combined DNA/RNA Molecule: Synthetic oligonucleotide
uuaugaagcagggaugacucuggga

SEQ ID NO: 1645 - DNA, 25 bp, Artificial Sequence
  Description of Artificial Sequence: Synthetic oligonucleotide
  Description of Combined DNA/RNA Molecule: Synthetic oligonucleotide
uaugaagcagggaugacucugggag

SEQ ID NO: 1646 - DNA, 25 bp, Artificial Sequence
  Description of Artificial Sequence: Synthetic oligonucleotide
  Description of Combined DNA/RNA Molecule: Synthetic oligonucleotide
augaagcagggaugacucugggagc

SEQ ID NO: 1647 - DNA, 25 bp, Artificial Sequence
  Description of Artificial Sequence: Synthetic oligonucleotide
  Description of Combined DNA/RNA Molecule: Synthetic oligonucleotide
ugaagcagggaugacucugggagcc

SEQ ID NO: 1648 - DNA, 25 bp, Artificial Sequence
  Description of Artificial Sequence: Synthetic oligonucleotide
  Description of Combined DNA/RNA Molecule: Synthetic oligonucleotide
gaagcagggaugacucugggagccc

SEQ ID NO: 1649 - DNA, 25 bp, Artificial Sequence
  Description of Artificial Sequence: Synthetic oligonucleotide
  Description of Combined DNA/RNA Molecule: Synthetic oligonucleotide
aagcagggaugacucugggagcccg

SEQ ID NO: 1650 - DNA, 25 bp, Artificial Sequence
  Description of Artificial Sequence: Synthetic oligonucleotide
  Description of Combined DNA/RNA Molecule: Synthetic oligonucleotide
agcagggaugacucugggagcccgg

SEQ ID NO: 1651 - DNA, 25 bp, Artificial Sequence
  Description of Artificial Sequence: Synthetic oligonucleotide
  Description of Combined DNA/RNA Molecule: Synthetic oligonucleotide
gcagggaugacucugggagcccgga

SEQ ID NO: 1652 - DNA, 25 bp, Artificial Sequence
  Description of Artificial Sequence: Synthetic oligonucleotide
  Description of Combined DNA/RNA Molecule: Synthetic oligonucleotide
cagggaugacucugggagcccggaa

SEQ ID NO: 1653 - DNA, 25 bp, Artificial Sequence
  Description of Artificial Sequence: Synthetic oligonucleotide
  Description of Combined DNA/RNA Molecule: Synthetic oligonucleotide
gaagaaacuugguaaucugaaacta

SEQ ID NO: 1654 - DNA, 25 bp, Artificial Sequence
  Description of Artificial Sequence: Synthetic oligonucleotide
  Description of Combined DNA/RNA Molecule: Synthetic oligonucleotide
aaacuacaggaggaaggagaggctt

SEQ ID NO: 1655 - DNA, 25 bp, Artificial Sequence
  Description of Artificial Sequence: Synthetic oligonucleotide
  Description of Combined DNA/RNA Molecule: Synthetic oligonucleotide
aacuacaggaggaaggagaggcutc

SEQ ID NO: 1656 - DNA, 25 bp, Artificial Sequence
  Description of Artificial Sequence: Synthetic oligonucleotide
  Description of Combined DNA/RNA Molecule: Synthetic oligonucleotide
cauugaaggcuaugaaugucagccc

SEQ ID NO: 1657 - DNA, 25 bp, Artificial Sequence
  Description of Artificial Sequence: Synthetic oligonucleotide
  Description of Combined DNA/RNA Molecule: Synthetic oligonucleotide
auugaaggcuaugaaugucagccca

SEQ ID NO: 1658 - DNA, 25 bp, Artificial Sequence
  Description of Artificial Sequence: Synthetic oligonucleotide
  Description of Combined DNA/RNA Molecule: Synthetic oligonucleotide
uugaaggcuaugaaugucagcccat

SEQ ID NO: 1659 - DNA, 25 bp, Artificial Sequence
  Description of Artificial Sequence: Synthetic oligonucleotide
  Description of Combined DNA/RNA Molecule: Synthetic oligonucleotide
ugaaggcuaugaaugucagcccatc

SEQ ID NO: 1660 - DNA, 25 bp, Artificial Sequence
  Description of Artificial Sequence: Synthetic oligonucleotide
  Description of Combined DNA/RNA Molecule: Synthetic oligonucleotide
gaaggcuaugaaugucagcccauct

SEQ ID NO: 1661 - DNA, 25 bp, Artificial Sequence
  Description of Artificial Sequence: Synthetic oligonucleotide
  Description of Combined DNA/RNA Molecule: Synthetic oligonucleotide
aaggcuaugaaugucagcccauctt

SEQ ID NO: 1662 - DNA, 25 bp, Artificial Sequence
  Description of Artificial Sequence: Synthetic oligonucleotide
  Description of Combined DNA/RNA Molecule: Synthetic oligonucleotide
guccuggaagccauugagccaggtg

SEQ ID NO: 1663 - DNA, 25 bp, Artificial Sequence
  Description of Artificial Sequence: Synthetic oligonucleotide
  Description of Combined DNA/RNA Molecule: Synthetic oligonucleotide
uccuggaagccauugagccaggugt

SEQ ID NO: 1664 - DNA, 25 bp, Artificial Sequence
  Description of Artificial Sequence: Synthetic oligonucleotide
  Description of Combined DNA/RNA Molecule: Synthetic oligonucleotide
ccuggaagccauugagccaggugta

SEQ ID NO: 1665 - DNA, 25 bp, Artificial Sequence
  Description of Artificial Sequence: Synthetic oligonucleotide
  Description of Combined DNA/RNA Molecule: Synthetic oligonucleotide
cuggaagccauugagccagguguag

SEQ ID NO: 1666 - DNA, 25 bp, Artificial Sequence
  Description of Artificial Sequence: Synthetic oligonucleotide
  Description of Combined DNA/RNA Molecule: Synthetic oligonucleotide
uggaagccauugagccagguguagt

SEQ ID NO: 1667 - DNA, 25 bp, Artificial Sequence
  Description of Artificial Sequence: Synthetic oligonucleotide
  Description of Combined DNA/RNA Molecule: Synthetic oligonucleotide
cagcccgacuccuuugcagccuugc

SEQ ID NO: 1668 - DNA, 25 bp, Artificial Sequence
  Description of Artificial Sequence: Synthetic oligonucleotide
  Description of Combined DNA/RNA Molecule: Synthetic oligonucleotide
gacuccuuugcagccuugcucucta

SEQ ID NO: 1669 - DNA, 25 bp, Artificial Sequence
  Description of Artificial Sequence: Synthetic oligonucleotide
  Description of Combined DNA/RNA Molecule: Synthetic oligonucleotide
cagccuugcucucuagccucaauga

SEQ ID NO: 1670 - DNA, 25 bp, Artificial Sequence
  Description of Artificial Sequence: Synthetic oligonucleotide
  Description of Combined DNA/RNA Molecule: Synthetic oligonucleotide
guggucaagugggccaaggccuugc

SEQ ID NO: 1671 - DNA, 25 bp, Artificial Sequence
  Description of Artificial Sequence: Synthetic oligonucleotide
  Description of Combined DNA/RNA Molecule: Synthetic oligonucleotide
uggucaagugggccaaggccuugcc

SEQ ID NO: 1672 - DNA, 25 bp, Artificial Sequence
  Description of Artificial Sequence: Synthetic oligonucleotide
  Description of Combined DNA/RNA Molecule: Synthetic oligonucleotide
ggucaagugggccaaggccuugcct

SEQ ID NO: 1673 - DNA, 25 bp, Artificial Sequence
  Description of Artificial Sequence: Synthetic oligonucleotide
  Description of Combined DNA/RNA Molecule: Synthetic oligonucleotide
gucaagugggccaaggccuugcctg

SEQ ID NO: 1674 - DNA, 25 bp, Artificial Sequence
  Description of Artificial Sequence: Synthetic oligonucleotide
  Description of Combined DNA/RNA Molecule: Synthetic oligonucleotide
ucaagugggccaaggccuugccugg

SEQ ID NO: 1675 - DNA, 25 bp, Artificial Sequence
  Description of Artificial Sequence: Synthetic oligonucleotide
  Description of Combined DNA/RNA Molecule: Synthetic oligonucleotide
caagugggccaaggccuugccuggc

SEQ ID NO: 1676 - DNA, 25 bp, Artificial Sequence
  Description of Artificial Sequence: Synthetic oligonucleotide
  Description of Combined DNA/RNA Molecule: Synthetic oligonucleotide
aagugggccaaggccuugccuggct

SEQ ID NO: 1677 - DNA, 25 bp, Artificial Sequence
  Description of Artificial Sequence: Synthetic oligonucleotide
  Description of Combined DNA/RNA Molecule: Synthetic oligonucleotide
agugggccaaggccuugccuggctt

SEQ ID NO: 1678 - DNA, 25 bp, Artificial Sequence
  Description of Artificial Sequence: Synthetic oligonucleotide
  Description of Combined DNA/RNA Molecule: Synthetic oligonucleotide
gugggccaaggccuugccuggcutc

SEQ ID NO: 1679 - DNA, 25 bp, Artificial Sequence
  Description of Artificial Sequence: Synthetic oligonucleotide
  Description of Combined DNA/RNA Molecule: Synthetic oligonucleotide
ugggccaaggccuugccuggcuucc

SEQ ID NO: 1680 - DNA, 25 bp, Artificial Sequence
  Description of Artificial Sequence: Synthetic oligonucleotide
  Description of Combined DNA/RNA Molecule: Synthetic oligonucleotide
gggccaaggccuugccuggcuuccg

SEQ ID NO: 1681 - DNA, 25 bp, Artificial Sequence
  Description of Artificial Sequence: Synthetic oligonucleotide
  Description of Combined DNA/RNA Molecule: Synthetic oligonucleotide
ggccaaggccuugccuggcuuccgc

SEQ ID NO: 1682 - DNA, 25 bp, Artificial Sequence
  Description of Artificial Sequence: Synthetic oligonucleotide
  Description of Combined DNA/RNA Molecule: Synthetic oligonucleotide
gccaaggccuugccuggcuuccgca

SEQ ID NO: 1683 - DNA, 25 bp, Artificial Sequence
  Description of Artificial Sequence: Synthetic oligonucleotide
  Description of Combined DNA/RNA Molecule: Synthetic oligonucleotide
ccaaggccuugccuggcuuccgcaa

SEQ ID NO: 1684 - DNA, 25 bp, Artificial Sequence
  Description of Artificial Sequence: Synthetic oligonucleotide
  Description of Combined DNA/RNA Molecule: Synthetic oligonucleotide
caaggccuugccuggcuuccgcaac

SEQ ID NO: 1685 - DNA, 25 bp, Artificial Sequence
  Description of Artificial Sequence: Synthetic oligonucleotide
  Description of Combined DNA/RNA Molecule: Synthetic oligonucleotide
aaggccuugccuggcuuccgcaact

SEQ ID NO: 1686 - DNA, 25 bp, Artificial Sequence
  Description of Artificial Sequence: Synthetic oligonucleotide
  Description of Combined DNA/RNA Molecule: Synthetic oligonucleotide
aggccuugccuggcuuccgcaactt

SEQ ID NO: 1687 - DNA, 25 bp, Artificial Sequence
  Description of Artificial Sequence: Synthetic oligonucleotide
  Description of Combined DNA/RNA Molecule: Synthetic oligonucleotide
ggccuugccuggcuuccgcaacuta

SEQ ID NO: 1688 - DNA, 25 bp, Artificial Sequence
  Description of Artificial Sequence: Synthetic oligonucleotide
  Description of Combined DNA/RNA Molecule: Synthetic oligonucleotide
gccuugccuggcuuccgcaacuuac

SEQ ID NO: 1689 - DNA, 25 bp, Artificial Sequence
  Description of Artificial Sequence: Synthetic oligonucleotide
  Description of Combined DNA/RNA Molecule: Synthetic oligonucleotide
ccuugccuggcuuccgcaacuuaca

SEQ ID NO: 1690 - DNA, 25 bp, Artificial Sequence
  Description of Artificial Sequence: Synthetic oligonucleotide
  Description of Combined DNA/RNA Molecule: Synthetic oligonucleotide
cuugccuggcuuccgcaacuuacac

SEQ ID NO: 1691 - DNA, 25 bp, Artificial Sequence
  Description of Artificial Sequence: Synthetic oligonucleotide
  Description of Combined DNA/RNA Molecule: Synthetic oligonucleotide
uugccuggcuuccgcaacuuacacg

SEQ ID NO: 1692 - DNA, 25 bp, Artificial Sequence
  Description of Artificial Sequence: Synthetic oligonucleotide
  Description of Combined DNA/RNA Molecule: Synthetic oligonucleotide
ugccuggcuuccgcaacuuacacgt

SEQ ID NO: 1693 - DNA, 25 bp, Artificial Sequence
  Description of Artificial Sequence: Synthetic oligonucleotide
  Description of Combined DNA/RNA Molecule: Synthetic oligonucleotide
aaugucaacuccaggaugcucuact

SEQ ID NO: 1694 - DNA, 25 bp, Artificial Sequence
  Description of Artificial Sequence: Synthetic oligonucleotide
  Description of Combined DNA/RNA Molecule: Synthetic oligonucleotide
augucaacuccaggaugcucuactt

SEQ ID NO: 1695 - DNA, 25 bp, Artificial Sequence
  Description of Artificial Sequence: Synthetic oligonucleotide
  Description of Combined DNA/RNA Molecule: Synthetic oligonucleotide
ugucaacuccaggaugcucuacutc

SEQ ID NO: 1696 - DNA, 25 bp, Artificial Sequence
  Description of Artificial Sequence: Synthetic oligonucleotide
  Description of Combined DNA/RNA Molecule: Synthetic oligonucleotide
gucaacuccaggaugcucuacuucg

SEQ ID NO: 1697 - DNA, 25 bp, Artificial Sequence
  Description of Artificial Sequence: Synthetic oligonucleotide
  Description of Combined DNA/RNA Molecule: Synthetic oligonucleotide
ucaacuccaggaugcucuacuucgc

SEQ ID NO: 1698 - DNA, 25 bp, Artificial Sequence
  Description of Artificial Sequence: Synthetic oligonucleotide
  Description of Combined DNA/RNA Molecule: Synthetic oligonucleotide
caacuccaggaugcucuacuucgcc

SEQ ID NO: 1699 - DNA, 25 bp, Artificial Sequence
  Description of Artificial Sequence: Synthetic oligonucleotide
  Description of Combined DNA/RNA Molecule: Synthetic oligonucleotide
aacuccaggaugcucuacuucgccc

SEQ ID NO: 1700 - DNA, 25 bp, Artificial Sequence
  Description of Artificial Sequence: Synthetic oligonucleotide
  Description of Combined DNA/RNA Molecule: Synthetic oligonucleotide
ugguuuucaaugaguaccgcaugca

SEQ ID NO: 1701 - DNA, 25 bp, Artificial Sequence
  Description of Artificial Sequence: Synthetic oligonucleotide
  Description of Combined DNA/RNA Molecule: Synthetic oligonucleotide
gguuuucaaugaguaccgcaugcac

SEQ ID NO: 1702 - DNA, 25 bp, Artificial Sequence
  Description of Artificial Sequence: Synthetic oligonucleotide
  Description of Combined DNA/RNA Molecule: Synthetic oligonucleotide
guuuucaaugaguaccgcaugcaca

SEQ ID NO: 1703 - DNA, 25 bp, Artificial Sequence
  Description of Artificial Sequence: Synthetic oligonucleotide
  Description of Combined DNA/RNA Molecule: Synthetic oligonucleotide
uuuucaaugaguaccgcaugcacaa

SEQ ID NO: 1704 - DNA, 25 bp, Artificial Sequence
  Description of Artificial Sequence: Synthetic oligonucleotide
  Description of Combined DNA/RNA Molecule: Synthetic oligonucleotide
uuucaaugaguaccgcaugcacaag

SEQ ID NO: 1705 - DNA, 25 bp, Artificial Sequence
  Description of Artificial Sequence: Synthetic oligonucleotide
  Description of Combined DNA/RNA Molecule: Synthetic oligonucleotide
uucaaugaguaccgcaugcacaagt

SEQ ID NO: 1706 - DNA, 25 bp, Artificial Sequence
  Description of Artificial Sequence: Synthetic oligonucleotide
  Description of Combined DNA/RNA Molecule: Synthetic oligonucleotide
ucaaugaguaccgcaugcacaagtc

SEQ ID NO: 1707 - DNA, 25 bp, Artificial Sequence
  Description of Artificial Sequence: Synthetic oligonucleotide
  Description of Combined DNA/RNA Molecule: Synthetic oligonucleotide
caaugaguaccgcaugcacaagucc

SEQ ID NO: 1708 - DNA, 25 bp, Artificial Sequence
  Description of Artificial Sequence: Synthetic oligonucleotide
  Description of Combined DNA/RNA Molecule: Synthetic oligonucleotide
aaugaguaccgcaugcacaaguccc

SEQ ID NO: 1709 - DNA, 25 bp, Artificial Sequence
  Description of Artificial Sequence: Synthetic oligonucleotide
  Description of Combined DNA/RNA Molecule: Synthetic oligonucleotide
augaguaccgcaugcacaagucccg

SEQ ID NO: 1710 - DNA, 25 bp, Artificial Sequence
  Description of Artificial Sequence: Synthetic oligonucleotide
  Description of Combined DNA/RNA Molecule: Synthetic oligonucleotide
ugaguaccgcaugcacaagucccgg

SEQ ID NO: 1711 - DNA, 25 bp, Artificial Sequence
  Description of Artificial Sequence: Synthetic oligonucleotide
  Description of Combined DNA/RNA Molecule: Synthetic oligonucleotide
gaguaccgcaugcacaagucccgga

SEQ ID NO: 1712 - DNA, 25 bp, Artificial Sequence
  Description of Artificial Sequence: Synthetic oligonucleotide
  Description of Combined DNA/RNA Molecule: Synthetic oligonucleotide
aguaccgcaugcacaagucccggat

SEQ ID NO: 1713 - DNA, 25 bp, Artificial Sequence
  Description of Artificial Sequence: Synthetic oligonucleotide
  Description of Combined DNA/RNA Molecule: Synthetic oligonucleotide
ucucaagaguuuggauggcuccaaa

SEQ ID NO: 1714 - DNA, 25 bp, Artificial Sequence
  Description of Artificial Sequence: Synthetic oligonucleotide
  Description of Combined DNA/RNA Molecule: Synthetic oligonucleotide
cucaagaguuuggauggcuccaaat

SEQ ID NO: 1715 - DNA, 25 bp, Artificial Sequence
  Description of Artificial Sequence: Synthetic oligonucleotide
  Description of Combined DNA/RNA Molecule: Synthetic oligonucleotide
ucaagaguuuggauggcuccaaatc

SEQ ID NO: 1716 - DNA, 25 bp, Artificial Sequence
  Description of Artificial Sequence: Synthetic oligonucleotide
  Description of Combined DNA/RNA Molecule: Synthetic oligonucleotide
caagaguuuggauggcuccaaauca

SEQ ID NO: 1717 - DNA, 25 bp, Artificial Sequence
  Description of Artificial Sequence: Synthetic oligonucleotide
  Description of Combined DNA/RNA Molecule: Synthetic oligonucleotide
aagaguuuggauggcuccaaaucac

SEQ ID NO: 1718 - DNA, 25 bp, Artificial Sequence
  Description of Artificial Sequence: Synthetic oligonucleotide
  Description of Combined DNA/RNA Molecule: Synthetic oligonucleotide
agaguuuggauggcuccaaaucacc

SEQ ID NO: 1719 - DNA, 25 bp, Artificial Sequence
  Description of Artificial Sequence: Synthetic oligonucleotide
  Description of Combined DNA/RNA Molecule: Synthetic oligonucleotide
gaguuuggauggcuccaaaucaccc

SEQ ID NO: 1720 - DNA, 25 bp, Artificial Sequence
  Description of Artificial Sequence: Synthetic oligonucleotide
  Description of Combined DNA/RNA Molecule: Synthetic oligonucleotide
caggaauuccugugcaugaaagcac

SEQ ID NO: 1721 - DNA, 25 bp, Artificial Sequence
  Description of Artificial Sequence: Synthetic oligonucleotide
  Description of Combined DNA/RNA Molecule: Synthetic oligonucleotide
aggaauuccugugcaugaaagcact

SEQ ID NO: 1722 - DNA, 25 bp, Artificial Sequence
  Description of Artificial Sequence: Synthetic oligonucleotide
  Description of Combined DNA/RNA Molecule: Synthetic oligonucleotide
ggaauuccugugcaugaaagcactg

SEQ ID NO: 1723 - DNA, 25 bp, Artificial Sequence
  Description of Artificial Sequence: Synthetic oligonucleotide
  Description of Combined DNA/RNA Molecule: Synthetic oligonucleotide
gaauuccugugcaugaaagcacugc

SEQ ID NO: 1724 - DNA, 25 bp, Artificial Sequence
  Description of Artificial Sequence: Synthetic oligonucleotide
  Description of Combined DNA/RNA Molecule: Synthetic oligonucleotide
aauuccugugcaugaaagcacugct

SEQ ID NO: 1725 - DNA, 25 bp, Artificial Sequence
  Description of Artificial Sequence: Synthetic oligonucleotide
  Description of Combined DNA/RNA Molecule: Synthetic oligonucleotide
auuccugugcaugaaagcacugcta

SEQ ID NO: 1726 - DNA, 25 bp, Artificial Sequence
  Description of Artificial Sequence: Synthetic oligonucleotide
  Description of Combined DNA/RNA Molecule: Synthetic oligonucleotide
uuccugugcaugaaagcacugcuac

SEQ ID NO: 1727 - DNA, 25 bp, Artificial Sequence
  Description of Artificial Sequence: Synthetic oligonucleotide
  Description of Combined DNA/RNA Molecule: Synthetic oligonucleotide
uccugugcaugaaagcacugcuact

SEQ ID NO: 1728 - DNA, 25 bp, Artificial Sequence
  Description of Artificial Sequence: Synthetic oligonucleotide
  Description of Combined DNA/RNA Molecule: Synthetic oligonucleotide
ccugugcaugaaagcacugcuactc

SEQ ID NO: 1729 - DNA, 25 bp, Artificial Sequence
  Description of Artificial Sequence: Synthetic oligonucleotide
  Description of Combined DNA/RNA Molecule: Synthetic oligonucleotide
cugugcaugaaagcacugcuacuct

SEQ ID NO: 1730 - DNA, 25 bp, Artificial Sequence
  Description of Artificial Sequence: Synthetic oligonucleotide
  Description of Combined DNA/RNA Molecule: Synthetic oligonucleotide
ugugcaugaaagcacugcuacuctt

SEQ ID NO: 1731 - DNA, 25 bp, Artificial Sequence
  Description of Artificial Sequence: Synthetic oligonucleotide
  Description of Combined DNA/RNA Molecule: Synthetic oligonucleotide
cucuucagcauuauuccaguggatg

SEQ ID NO: 1732 - DNA, 25 bp, Artificial Sequence
  Description of Artificial Sequence: Synthetic oligonucleotide
  Description of Combined DNA/RNA Molecule: Synthetic oligonucleotide
ucuucagcauuauuccaguggaugg

SEQ ID NO: 1733 - DNA, 25 bp, Artificial Sequence
  Description of Artificial Sequence: Synthetic oligonucleotide
  Description of Combined DNA/RNA Molecule: Synthetic oligonucleotide
cuucagcauuauuccaguggauggg

SEQ ID NO: 1734 - DNA, 25 bp, Artificial Sequence
  Description of Artificial Sequence: Synthetic oligonucleotide
  Description of Combined DNA/RNA Molecule: Synthetic oligonucleotide
uucagcauuauuccaguggaugggc

SEQ ID NO: 1735 - DNA, 25 bp, Artificial Sequence
  Description of Artificial Sequence: Synthetic oligonucleotide
  Description of Combined DNA/RNA Molecule: Synthetic oligonucleotide
ucagcauuauuccaguggaugggct

SEQ ID NO: 1736 - DNA, 25 bp, Artificial Sequence
  Description of Artificial Sequence: Synthetic oligonucleotide
  Description of Combined DNA/RNA Molecule: Synthetic oligonucleotide
cagcauuauuccaguggaugggctg

SEQ ID NO: 1737 - DNA, 25 bp, Artificial Sequence
  Description of Artificial Sequence: Synthetic oligonucleotide
  Description of Combined DNA/RNA Molecule: Synthetic oligonucleotide
agcauuauuccaguggaugggcuga

SEQ ID NO: 1738 - DNA, 25 bp, Artificial Sequence
  Description of Artificial Sequence: Synthetic oligonucleotide
  Description of Combined DNA/RNA Molecule: Synthetic oligonucleotide
gcauuauuccaguggaugggcugaa

SEQ ID NO: 1739 - DNA, 25 bp, Artificial Sequence
  Description of Artificial Sequence: Synthetic oligonucleotide
  Description of Combined DNA/RNA Molecule: Synthetic oligonucleotide
cauuauuccaguggaugggcugaaa

SEQ ID NO: 1740 - DNA, 25 bp, Artificial Sequence
  Description of Artificial Sequence: Synthetic oligonucleotide
  Description of Combined DNA/RNA Molecule: Synthetic oligonucleotide
auuauuccaguggaugggcugaaaa

SEQ ID NO: 1741 - DNA, 25 bp, Artificial Sequence
  Description of Artificial Sequence: Synthetic oligonucleotide
  Description of Combined DNA/RNA Molecule: Synthetic oligonucleotide
uuauuccaguggaugggcugaaaaa

SEQ ID NO: 1742 - DNA, 25 bp, Artificial Sequence
  Description of Artificial Sequence: Synthetic oligonucleotide
  Description of Combined DNA/RNA Molecule: Synthetic oligonucleotide
uauuccaguggaugggcugaaaaat

SEQ ID NO: 1743 - DNA, 25 bp, Artificial Sequence
  Description of Artificial Sequence: Synthetic oligonucleotide
  Description of Combined DNA/RNA Molecule: Synthetic oligonucleotide
auuccaguggaugggcugaaaaatc

SEQ ID NO: 1744 - DNA, 25 bp, Artificial Sequence
  Description of Artificial Sequence: Synthetic oligonucleotide
  Description of Combined DNA/RNA Molecule: Synthetic oligonucleotide
uuccaguggaugggcugaaaaauca

SEQ ID NO: 1745 - DNA, 25 bp, Artificial Sequence
  Description of Artificial Sequence: Synthetic oligonucleotide
  Description of Combined DNA/RNA Molecule: Synthetic oligonucleotide
uccaguggaugggcugaaaaaucaa

SEQ ID NO: 1746 - DNA, 25 bp, Artificial Sequence
  Description of Artificial Sequence: Synthetic oligonucleotide
  Description of Combined DNA/RNA Molecule: Synthetic oligonucleotide
ccaguggaugggcugaaaaaucaaa

SEQ ID NO: 1747 - DNA, 25 bp, Artificial Sequence
  Description of Artificial Sequence: Synthetic oligonucleotide
  Description of Combined DNA/RNA Molecule: Synthetic oligonucleotide
caguggaugggcugaaaaaucaaaa

SEQ ID NO: 1748 - DNA, 25 bp, Artificial Sequence
  Description of Artificial Sequence: Synthetic oligonucleotide
  Description of Combined DNA/RNA Molecule: Synthetic oligonucleotide
aguggaugggcugaaaaaucaaaaa

SEQ ID NO: 1749 - DNA, 25 bp, Artificial Sequence
  Description of Artificial Sequence: Synthetic oligonucleotide
  Description of Combined DNA/RNA Molecule: Synthetic oligonucleotide
guggaugggcugaaaaaucaaaaat

SEQ ID NO: 1750 - DNA, 25 bp, Artificial Sequence
  Description of Artificial Sequence: Synthetic oligonucleotide
  Description of Combined DNA/RNA Molecule: Synthetic oligonucleotide
uggaugggcugaaaaaucaaaaatt

SEQ ID NO: 1751 - DNA, 25 bp, Artificial Sequence
  Description of Artificial Sequence: Synthetic oligonucleotide
  Description of Combined DNA/RNA Molecule: Synthetic oligonucleotide
ggaugggcugaaaaaucaaaaautc

SEQ ID NO: 1752 - DNA, 25 bp, Artificial Sequence
  Description of Artificial Sequence: Synthetic oligonucleotide
  Description of Combined DNA/RNA Molecule: Synthetic oligonucleotide
gaugggcugaaaaaucaaaaauuct

SEQ ID NO: 1753 - DNA, 25 bp, Artificial Sequence
  Description of Artificial Sequence: Synthetic oligonucleotide
  Description of Combined DNA/RNA Molecule: Synthetic oligonucleotide
augggcugaaaaaucaaaaauuctt

SEQ ID NO: 1754 - DNA, 25 bp, Artificial Sequence
  Description of Artificial Sequence: Synthetic oligonucleotide
  Description of Combined DNA/RNA Molecule: Synthetic oligonucleotide
ugggcugaaaaaucaaaaauucutt

SEQ ID NO: 1755 - DNA, 25 bp, Artificial Sequence
  Description of Artificial Sequence: Synthetic oligonucleotide
  Description of Combined DNA/RNA Molecule: Synthetic oligonucleotide
gggcugaaaaaucaaaaauucuutg

SEQ ID NO: 1756 - DNA, 25 bp, Artificial Sequence
  Description of Artificial Sequence: Synthetic oligonucleotide
  Description of Combined DNA/RNA Molecule: Synthetic oligonucleotide
ggcugaaaaaucaaaaauucuuuga

SEQ ID NO: 1757 - DNA, 25 bp, Artificial Sequence
  Description of Artificial Sequence: Synthetic oligonucleotide
  Description of Combined DNA/RNA Molecule: Synthetic oligonucleotide
gcugaaaaaucaaaaauucuuugat

SEQ ID NO: 1758 - DNA, 25 bp, Artificial Sequence
  Description of Artificial Sequence: Synthetic oligonucleotide
  Description of Combined DNA/RNA Molecule: Synthetic oligonucleotide
cugaaaaaucaaaaauucuuugatg

SEQ ID NO: 1759 - DNA, 25 bp, Artificial Sequence
  Description of Artificial Sequence: Synthetic oligonucleotide
  Description of Combined DNA/RNA Molecule: Synthetic oligonucleotide
ugaaaaaucaaaaauucuuugauga

SEQ ID NO: 1760 - DNA, 25 bp, Artificial Sequence
  Description of Artificial Sequence: Synthetic oligonucleotide
  Description of Combined DNA/RNA Molecule: Synthetic oligonucleotide
gaaaaaucaaaaauucuuugaugaa

SEQ ID NO: 1761 - DNA, 25 bp, Artificial Sequence
  Description of Artificial Sequence: Synthetic oligonucleotide
  Description of Combined DNA/RNA Molecule: Synthetic oligonucleotide
aaaaaucaaaaauucuuugaugaac

SEQ ID NO: 1762 - DNA, 25 bp, Artificial Sequence
  Description of Artificial Sequence: Synthetic oligonucleotide
  Description of Combined DNA/RNA Molecule: Synthetic oligonucleotide
aaaucaaaaauucuuugaugaactt

SEQ ID NO: 1763 - DNA, 25 bp, Artificial Sequence
  Description of Artificial Sequence: Synthetic oligonucleotide
  Description of Combined DNA/RNA Molecule: Synthetic oligonucleotide
aaucaaaaauucuuugaugaacutc

SEQ ID NO: 1764 - DNA, 25 bp, Artificial Sequence
  Description of Artificial Sequence: Synthetic oligonucleotide
  Description of Combined DNA/RNA Molecule: Synthetic oligonucleotide
aucaaaaauucuuugaugaacuucg

SEQ ID NO: 1765 - DNA, 25 bp, Artificial Sequence
  Description of Artificial Sequence: Synthetic oligonucleotide
  Description of Combined DNA/RNA Molecule: Synthetic oligonucleotide
ucaaaaauucuuugaugaacuucga

SEQ ID NO: 1766 - DNA, 25 bp, Artificial Sequence
  Description of Artificial Sequence: Synthetic oligonucleotide
  Description of Combined DNA/RNA Molecule: Synthetic oligonucleotide
caaaaauucuuugaugaacuucgaa

SEQ ID NO: 1767 - DNA, 25 bp, Artificial Sequence
  Description of Artificial Sequence: Synthetic oligonucleotide
  Description of Combined DNA/RNA Molecule: Synthetic oligonucleotide
aaaaauucuuugaugaacuucgaat

SEQ ID NO: 1768 - DNA, 25 bp, Artificial Sequence
  Description of Artificial Sequence: Synthetic oligonucleotide
  Description of Combined DNA/RNA Molecule: Synthetic oligonucleotide
aaaauucuuugaugaacuucgaatg

SEQ ID NO: 1769 - DNA, 25 bp, Artificial Sequence
  Description of Artificial Sequence: Synthetic oligonucleotide
  Description of Combined DNA/RNA Molecule: Synthetic oligonucleotide
aaauucuuugaugaacuucgaauga

SEQ ID NO: 1770 - DNA, 25 bp, Artificial Sequence
  Description of Artificial Sequence: Synthetic oligonucleotide
  Description of Combined DNA/RNA Molecule: Synthetic oligonucleotide
aauucuuugaugaacuucgaaugaa

SEQ ID NO: 1771 - DNA, 25 bp, Artificial Sequence
  Description of Artificial Sequence: Synthetic oligonucleotide
  Description of Combined DNA/RNA Molecule: Synthetic oligonucleotide
auucuuugaugaacuucgaaugaac

SEQ ID NO: 1772 - DNA, 25 bp, Artificial Sequence
  Description of Artificial Sequence: Synthetic oligonucleotide
  Description of Combined DNA/RNA Molecule: Synthetic oligonucleotide
uucuuugaugaacuucgaaugaact

SEQ ID NO: 1773 - DNA, 25 bp, Artificial Sequence
  Description of Artificial Sequence: Synthetic oligonucleotide
  Description of Combined DNA/RNA Molecule: Synthetic oligonucleotide
ucuuugaugaacuucgaaugaacta

SEQ ID NO: 1774 - DNA, 25 bp, Artificial Sequence
  Description of Artificial Sequence: Synthetic oligonucleotide
  Description of Combined DNA/RNA Molecule: Synthetic oligonucleotide
cuuugaugaacuucgaaugaacuac

SEQ ID NO: 1775 - DNA, 25 bp, Artificial Sequence
  Description of Artificial Sequence: Synthetic oligonucleotide
  Description of Combined DNA/RNA Molecule: Synthetic oligonucleotide
uuugaugaacuucgaaugaacuaca

SEQ ID NO: 1776 - DNA, 25 bp, Artificial Sequence
  Description of Artificial Sequence: Synthetic oligonucleotide
  Description of Combined DNA/RNA Molecule: Synthetic oligonucleotide
uugaugaacuucgaaugaacuacat

SEQ ID NO: 1777 - DNA, 25 bp, Artificial Sequence
  Description of Artificial Sequence: Synthetic oligonucleotide
  Description of Combined DNA/RNA Molecule: Synthetic oligonucleotide
ugaugaacuucgaaugaacuacatc

SEQ ID NO: 1778 - DNA, 25 bp, Artificial Sequence
  Description of Artificial Sequence: Synthetic oligonucleotide
  Description of Combined DNA/RNA Molecule: Synthetic oligonucleotide
gaugaacuucgaaugaacuacauca

SEQ ID NO: 1779 - DNA, 25 bp, Artificial Sequence
  Description of Artificial Sequence: Synthetic oligonucleotide
  Description of Combined DNA/RNA Molecule: Synthetic oligonucleotide
augaacuucgaaugaacuacaucaa

SEQ ID NO: 1780 - DNA, 25 bp, Artificial Sequence
  Description of Artificial Sequence: Synthetic oligonucleotide
  Description of Combined DNA/RNA Molecule: Synthetic oligonucleotide
ugaacuucgaaugaacuacaucaag

SEQ ID NO: 1781 - DNA, 25 bp, Artificial Sequence
  Description of Artificial Sequence: Synthetic oligonucleotide
  Description of Combined DNA/RNA Molecule: Synthetic oligonucleotide
gaacuucgaaugaacuacaucaagg

SEQ ID NO: 1782 - DNA, 25 bp, Artificial Sequence
  Description of Artificial Sequence: Synthetic oligonucleotide
  Description of Combined DNA/RNA Molecule: Synthetic oligonucleotide
aacuucgaaugaacuacaucaagga

SEQ ID NO: 1783 - DNA, 25 bp, Artificial Sequence
  Description of Artificial Sequence: Synthetic oligonucleotide
  Description of Combined DNA/RNA Molecule: Synthetic oligonucleotide
acuucgaaugaacuacaucaaggaa

SEQ ID NO: 1784 - DNA, 25 bp, Artificial Sequence
  Description of Artificial Sequence: Synthetic oligonucleotide
  Description of Combined DNA/RNA Molecule: Synthetic oligonucleotide
cuucgaaugaacuacaucaaggaac

SEQ ID NO: 1785 - DNA, 25 bp, Artificial Sequence
  Description of Artificial Sequence: Synthetic oligonucleotide
  Description of Combined DNA/RNA Molecule: Synthetic oligonucleotide
uucgaaugaacuacaucaaggaact

SEQ ID NO: 1786 - DNA, 25 bp, Artificial Sequence
  Description of Artificial Sequence: Synthetic oligonucleotide
  Description of Combined DNA/RNA Molecule: Synthetic oligonucleotide
ucgaaugaacuacaucaaggaactc

SEQ ID NO: 1787 - DNA, 25 bp, Artificial Sequence
  Description of Artificial Sequence: Synthetic oligonucleotide
  Description of Combined DNA/RNA Molecule: Synthetic oligonucleotide
cgaaugaacuacaucaaggaacucg

SEQ ID NO: 1788 - DNA, 25 bp, Artificial Sequence
  Description of Artificial Sequence: Synthetic oligonucleotide
  Description of Combined DNA/RNA Molecule: Synthetic oligonucleotide
gaaugaacuacaucaaggaacucga

SEQ ID NO: 1789 - DNA, 25 bp, Artificial Sequence
  Description of Artificial Sequence: Synthetic oligonucleotide
  Description of Combined DNA/RNA Molecule: Synthetic oligonucleotide
aaugaacuacaucaaggaacucgat

SEQ ID NO: 1790 - DNA, 25 bp, Artificial Sequence
  Description of Artificial Sequence: Synthetic oligonucleotide
  Description of Combined DNA/RNA Molecule: Synthetic oligonucleotide
augaacuacaucaaggaacucgatc

SEQ ID NO: 1791 - DNA, 25 bp, Artificial Sequence
  Description of Artificial Sequence: Synthetic oligonucleotide
  Description of Combined DNA/RNA Molecule: Synthetic oligonucleotide
ugaacuacaucaaggaacucgaucg

SEQ ID NO: 1792 - DNA, 25 bp, Artificial Sequence
  Description of Artificial Sequence: Synthetic oligonucleotide
  Description of Combined DNA/RNA Molecule: Synthetic oligonucleotide
gaacuacaucaaggaacucgaucgt

SEQ ID NO: 1793 - DNA, 25 bp, Artificial Sequence
  Description of Artificial Sequence: Synthetic oligonucleotide
  Description of Combined DNA/RNA Molecule: Synthetic oligonucleotide
aacuacaucaaggaacucgaucgta

SEQ ID NO: 1794 - DNA, 25 bp, Artificial Sequence
  Description of Artificial Sequence: Synthetic oligonucleotide
  Description of Combined DNA/RNA Molecule: Synthetic oligonucleotide
acuacaucaaggaacucgaucguat

SEQ ID NO: 1795 - DNA, 25 bp, Artificial Sequence
  Description of Artificial Sequence: Synthetic oligonucleotide
  Description of Combined DNA/RNA Molecule: Synthetic oligonucleotide
cuacaucaaggaacucgaucguatc

SEQ ID NO: 1796 - DNA, 25 bp, Artificial Sequence
  Description of Artificial Sequence: Synthetic oligonucleotide
  Description of Combined DNA/RNA Molecule: Synthetic oligonucleotide
uacaucaaggaacucgaucguauca

SEQ ID NO: 1797 - DNA, 25 bp, Artificial Sequence
  Description of Artificial Sequence: Synthetic oligonucleotide
  Description of Combined DNA/RNA Molecule: Synthetic oligonucleotide
acaucaaggaacucgaucguaucat

SEQ ID NO: 1798 - DNA, 25 bp, Artificial Sequence
  Description of Artificial Sequence: Synthetic oligonucleotide
  Description of Combined DNA/RNA Molecule: Synthetic oligonucleotide
aucauugcaugcaaaagaaaaaatc

SEQ ID NO: 1799 - DNA, 25 bp, Artificial Sequence
  Description of Artificial Sequence: Synthetic oligonucleotide
  Description of Combined DNA/RNA Molecule: Synthetic oligonucleotide
ucauugcaugcaaaagaaaaaaucc

SEQ ID NO: 1800 - DNA, 25 bp, Artificial Sequence
  Description of Artificial Sequence: Synthetic oligonucleotide
  Description of Combined DNA/RNA Molecule: Synthetic oligonucleotide
aaucccacauccugcucaagacgct

SEQ ID NO: 1801 - DNA, 25 bp, Artificial Sequence
  Description of Artificial Sequence: Synthetic oligonucleotide
  Description of Combined DNA/RNA Molecule: Synthetic oligonucleotide
aucccacauccugcucaagacgctt

SEQ ID NO: 1802 - DNA, 25 bp, Artificial Sequence
  Description of Artificial Sequence: Synthetic oligonucleotide
  Description of Combined DNA/RNA Molecule: Synthetic oligonucleotide
cgcuucuaccagcucaccaagcucc

SEQ ID NO: 1803 - DNA, 25 bp, Artificial Sequence
  Description of Artificial Sequence: Synthetic oligonucleotide
  Description of Combined DNA/RNA Molecule: Synthetic oligonucleotide
gcuucuaccagcucaccaagcucct

SEQ ID NO: 1804 - DNA, 25 bp, Artificial Sequence
  Description of Artificial Sequence: Synthetic oligonucleotide
  Description of Combined DNA/RNA Molecule: Synthetic oligonucleotide
cuucuaccagcucaccaagcucctg

SEQ ID NO: 1805 - DNA, 25 bp, Artificial Sequence
  Description of Artificial Sequence: Synthetic oligonucleotide
  Description of Combined DNA/RNA Molecule: Synthetic oligonucleotide
uucuaccagcucaccaagcuccugg

SEQ ID NO: 1806 - DNA, 25 bp, Artificial Sequence
  Description of Artificial Sequence: Synthetic oligonucleotide
  Description of Combined DNA/RNA Molecule: Synthetic oligonucleotide
ucuaccagcucaccaagcuccugga

SEQ ID NO: 1807 - DNA, 25 bp, Artificial Sequence
  Description of Artificial Sequence: Synthetic oligonucleotide
  Description of Combined DNA/RNA Molecule: Synthetic oligonucleotide
cuaccagcucaccaagcuccuggac

SEQ ID NO: 1808 - DNA, 25 bp, Artificial Sequence
  Description of Artificial Sequence: Synthetic oligonucleotide
  Description of Combined DNA/RNA Molecule: Synthetic oligonucleotide
uaccagcucaccaagcuccuggact

SEQ ID NO: 1809 - DNA, 25 bp, Artificial Sequence
  Description of Artificial Sequence: Synthetic oligonucleotide
  Description of Combined DNA/RNA Molecule: Synthetic oligonucleotide
accagcucaccaagcuccuggactc

SEQ ID NO: 1810 - DNA, 25 bp, Artificial Sequence
  Description of Artificial Sequence: Synthetic oligonucleotide
  Description of Combined DNA/RNA Molecule: Synthetic oligonucleotide
ccagcucaccaagcuccuggacucc

SEQ ID NO: 1811 - DNA, 25 bp, Artificial Sequence
  Description of Artificial Sequence: Synthetic oligonucleotide
  Description of Combined DNA/RNA Molecule: Synthetic oligonucleotide
cagcucaccaagcuccuggacuccg

SEQ ID NO: 1812 - DNA, 25 bp, Artificial Sequence
  Description of Artificial Sequence: Synthetic oligonucleotide
  Description of Combined DNA/RNA Molecule: Synthetic oligonucleotide
agcucaccaagcuccuggacuccgt

SEQ ID NO: 1813 - DNA, 25 bp, Artificial Sequence
  Description of Artificial Sequence: Synthetic oligonucleotide
  Description of Combined DNA/RNA Molecule: Synthetic oligonucleotide
cucaccaagcuccuggacuccgugc

SEQ ID NO: 1814 - DNA, 25 bp, Artificial Sequence
  Description of Artificial Sequence: Synthetic oligonucleotide
  Description of Combined DNA/RNA Molecule: Synthetic oligonucleotide
cuccuggacuccgugcagccuautg

SEQ ID NO: 1815 - DNA, 25 bp, Artificial Sequence
  Description of Artificial Sequence: Synthetic oligonucleotide
  Description of Combined DNA/RNA Molecule: Synthetic oligonucleotide
cgugcagccuauugcgagagagctg

SEQ ID NO: 1816 - DNA, 25 bp, Artificial Sequence
  Description of Artificial Sequence: Synthetic oligonucleotide
  Description of Combined DNA/RNA Molecule: Synthetic oligonucleotide
agagagcugcaucaguucacuuutg

SEQ ID NO: 1817 - DNA, 25 bp, Artificial Sequence
  Description of Artificial Sequence: Synthetic oligonucleotide
  Description of Combined DNA/RNA Molecule: Synthetic oligonucleotide
gagagcugcaucaguucacuuuuga

SEQ ID NO: 1818 - DNA, 25 bp, Artificial Sequence
  Description of Artificial Sequence: Synthetic oligonucleotide
  Description of Combined DNA/RNA Molecule: Synthetic oligonucleotide
agagcugcaucaguucacuuuugac

SEQ ID NO: 1819 - DNA, 25 bp, Artificial Sequence
  Description of Artificial Sequence: Synthetic oligonucleotide
  Description of Combined DNA/RNA Molecule: Synthetic oligonucleotide
gagcugcaucaguucacuuuugacc

SEQ ID NO: 1820 - DNA, 25 bp, Artificial Sequence
  Description of Artificial Sequence: Synthetic oligonucleotide
  Description of Combined DNA/RNA Molecule: Synthetic oligonucleotide
agcugcaucaguucacuuuugacct

SEQ ID NO: 1821 - DNA, 25 bp, Artificial Sequence
  Description of Artificial Sequence: Synthetic oligonucleotide
  Description of Combined DNA/RNA Molecule: Synthetic oligonucleotide
gcugcaucaguucacuuuugacctg

SEQ ID NO: 1822 - DNA, 25 bp, Artificial Sequence
  Description of Artificial Sequence: Synthetic oligonucleotide
  Description of Combined DNA/RNA Molecule: Synthetic oligonucleotide
cugcaucaguucacuuuugaccugc

SEQ ID NO: 1823 - DNA, 25 bp, Artificial Sequence
  Description of Artificial Sequence: Synthetic oligonucleotide
  Description of Combined DNA/RNA Molecule: Synthetic oligonucleotide
ugcaucaguucacuuuugaccugct

SEQ ID NO: 1824 - DNA, 25 bp, Artificial Sequence
  Description of Artificial Sequence: Synthetic oligonucleotide
  Description of Combined DNA/RNA Molecule: Synthetic oligonucleotide
gcaucaguucacuuuugaccugcta

SEQ ID NO: 1825 - DNA, 25 bp, Artificial Sequence
  Description of Artificial Sequence: Synthetic oligonucleotide
  Description of Combined DNA/RNA Molecule: Synthetic oligonucleotide
caucaguucacuuuugaccugcuaa

SEQ ID NO: 1826 - DNA, 25 bp, Artificial Sequence
  Description of Artificial Sequence: Synthetic oligonucleotide
  Description of Combined DNA/RNA Molecule: Synthetic oligonucleotide
aucaguucacuuuugaccugcuaat

SEQ ID NO: 1827 - DNA, 25 bp, Artificial Sequence
  Description of Artificial Sequence: Synthetic oligonucleotide
  Description of Combined DNA/RNA Molecule: Synthetic oligonucleotide
ucaguucacuuuugaccugcuaatc

SEQ ID NO: 1828 - DNA, 25 bp, Artificial Sequence
  Description of Artificial Sequence: Synthetic oligonucleotide
  Description of Combined DNA/RNA Molecule: Synthetic oligonucleotide
caguucacuuuugaccugcuaauca

SEQ ID NO: 1829 - DNA, 25 bp, Artificial Sequence
  Description of Artificial Sequence: Synthetic oligonucleotide
  Description of Combined DNA/RNA Molecule: Synthetic oligonucleotide
aguucacuuuugaccugcuaaucaa

SEQ ID NO: 1830 - DNA, 25 bp, Artificial Sequence
  Description of Artificial Sequence: Synthetic oligonucleotide
  Description of Combined DNA/RNA Molecule: Synthetic oligonucleotide
guucacuuuugaccugcuaaucaag

SEQ ID NO: 1831 - DNA, 25 bp, Artificial Sequence
  Description of Artificial Sequence: Synthetic oligonucleotide
  Description of Combined DNA/RNA Molecule: Synthetic oligonucleotide
uucacuuuugaccugcuaaucaagt

SEQ ID NO: 1832 - DNA, 25 bp, Artificial Sequence
  Description of Artificial Sequence: Synthetic oligonucleotide
  Description of Combined DNA/RNA Molecule: Synthetic oligonucleotide
ucacuuuugaccugcuaaucaagtc

SEQ ID NO: 1833 - DNA, 25 bp, Artificial Sequence
  Description of Artificial Sequence: Synthetic oligonucleotide
  Description of Combined DNA/RNA Molecule: Synthetic oligonucleotide
cacuuuugaccugcuaaucaaguca

SEQ ID NO: 1834 - DNA, 25 bp, Artificial Sequence
  Description of Artificial Sequence: Synthetic oligonucleotide
  Description of Combined DNA/RNA Molecule: Synthetic oligonucleotide
acuuuugaccugcuaaucaagucac

SEQ ID NO: 1835 - DNA, 25 bp, Artificial Sequence
  Description of Artificial Sequence: Synthetic oligonucleotide
  Description of Combined DNA/RNA Molecule: Synthetic oligonucleotide
cuuuugaccugcuaaucaagucaca

SEQ ID NO: 1836 - DNA, 25 bp, Artificial Sequence
  Description of Artificial Sequence: Synthetic oligonucleotide
  Description of Combined DNA/RNA Molecule: Synthetic oligonucleotide
uuuugaccugcuaaucaagucacac

SEQ ID NO: 1837 - DNA, 25 bp, Artificial Sequence
  Description of Artificial Sequence: Synthetic oligonucleotide
  Description of Combined DNA/RNA Molecule: Synthetic oligonucleotide
auggugagcguggacuuuccggaaa

SEQ ID NO: 1838 - DNA, 25 bp, Artificial Sequence
  Description of Artificial Sequence: Synthetic oligonucleotide
  Description of Combined DNA/RNA Molecule: Synthetic oligonucleotide
uggugagcguggacuuuccggaaat

SEQ ID NO: 1839 - DNA, 25 bp, Artificial Sequence
  Description of Artificial Sequence: Synthetic oligonucleotide
  Description of Combined DNA/RNA Molecule: Synthetic oligonucleotide
gaaaugauggcagagaucaucuctg

SEQ ID NO: 1840 - DNA, 25 bp, Artificial Sequence
  Description of Artificial Sequence: Synthetic oligonucleotide
  Description of Combined DNA/RNA Molecule: Synthetic oligonucleotide
aaaugauggcagagaucaucucugt

SEQ ID NO: 1841 - DNA, 25 bp, Artificial Sequence
  Description of Artificial Sequence: Synthetic oligonucleotide
  Description of Combined DNA/RNA Molecule: Synthetic oligonucleotide
aaugauggcagagaucaucucugtg

SEQ ID NO: 1842 - DNA, 25 bp, Artificial Sequence
  Description of Artificial Sequence: Synthetic oligonucleotide
  Description of Combined DNA/RNA Molecule: Synthetic oligonucleotide
augauggcagagaucaucucugugc

SEQ ID NO: 1843 - DNA, 25 bp, Artificial Sequence
  Description of Artificial Sequence: Synthetic oligonucleotide
  Description of Combined DNA/RNA Molecule: Synthetic oligonucleotide
ugauggcagagaucaucucugugca

SEQ ID NO: 1844 - DNA, 25 bp, Artificial Sequence
  Description of Artificial Sequence: Synthetic oligonucleotide
  Description of Combined DNA/RNA Molecule: Synthetic oligonucleotide
gauggcagagaucaucucugugcaa

SEQ ID NO: 1845 - DNA, 25 bp, Artificial Sequence
  Description of Artificial Sequence: Synthetic oligonucleotide
  Description of Combined DNA/RNA Molecule: Synthetic oligonucleotide
auggcagagaucaucucugugcaag

SEQ ID NO: 1846 - DNA, 25 bp, Artificial Sequence
  Description of Artificial Sequence: Synthetic oligonucleotide
  Description of Combined DNA/RNA Molecule: Synthetic oligonucleotide
uggcagagaucaucucugugcaagt

SEQ ID NO: 1847 - DNA, 25 bp, Artificial Sequence
  Description of Artificial Sequence: Synthetic oligonucleotide
  Description of Combined DNA/RNA Molecule: Synthetic oligonucleotide
ggcagagaucaucucugugcaagtg

SEQ ID NO: 1848 - DNA, 25 bp, Artificial Sequence
  Description of Artificial Sequence: Synthetic oligonucleotide
  Description of Combined DNA/RNA Molecule: Synthetic oligonucleotide
gcagagaucaucucugugcaagugc

SEQ ID NO: 1849 - DNA, 25 bp, Artificial Sequence
  Description of Artificial Sequence: Synthetic oligonucleotide
  Description of Combined DNA/RNA Molecule: Synthetic oligonucleotide
cagagaucaucucugugcaagugcc

SEQ ID NO: 1850 - DNA, 25 bp, Artificial Sequence
  Description of Artificial Sequence: Synthetic oligonucleotide
  Description of Combined DNA/RNA Molecule: Synthetic oligonucleotide
agagaucaucucugugcaagugccc

SEQ ID NO: 1851 - DNA, 25 bp, Artificial Sequence
  Description of Artificial Sequence: Synthetic oligonucleotide
  Description of Combined DNA/RNA Molecule: Synthetic oligonucleotide
gagaucaucucugugcaagugccca

SEQ ID NO: 1852 - DNA, 25 bp, Artificial Sequence
  Description of Artificial Sequence: Synthetic oligonucleotide
  Description of Combined DNA/RNA Molecule: Synthetic oligonucleotide
agaucaucucugugcaagugcccaa

SEQ ID NO: 1853 - DNA, 25 bp, Artificial Sequence
  Description of Artificial Sequence: Synthetic oligonucleotide
  Description of Combined DNA/RNA Molecule: Synthetic oligonucleotide
gaucaucucugugcaagugcccaag

SEQ ID NO: 1854 - DNA, 25 bp, Artificial Sequence
  Description of Artificial Sequence: Synthetic oligonucleotide
  Description of Combined DNA/RNA Molecule: Synthetic oligonucleotide
aucaucucugugcaagugcccaaga

SEQ ID NO: 1855 - DNA, 25 bp, Artificial Sequence
  Description of Artificial Sequence: Synthetic oligonucleotide
  Description of Combined DNA/RNA Molecule: Synthetic oligonucleotide
ucaucucugugcaagugcccaagat

SEQ ID NO: 1856 - DNA, 25 bp, Artificial Sequence
  Description of Artificial Sequence: Synthetic oligonucleotide
  Description of Combined DNA/RNA Molecule: Synthetic oligonucleotide
caucucugugcaagugcccaagatc

SEQ ID NO: 1857 - DNA, 25 bp, Artificial Sequence
  Description of Artificial Sequence: Synthetic oligonucleotide
  Description of Combined DNA/RNA Molecule: Synthetic oligonucleotide
aucucugugcaagugcccaagaucc

SEQ ID NO: 1858 - DNA, 25 bp, Artificial Sequence
  Description of Artificial Sequence: Synthetic oligonucleotide
  Description of Combined DNA/RNA Molecule: Synthetic oligonucleotide
ucucugugcaagugcccaagaucct

SEQ ID NO: 1859 - DNA, 25 bp, Artificial Sequence
  Description of Artificial Sequence: Synthetic oligonucleotide
  Description of Combined DNA/RNA Molecule: Synthetic oligonucleotide
cucugugcaagugcccaagaucctt

SEQ ID NO: 1860 - DNA, 25 bp, Artificial Sequence
  Description of Artificial Sequence: Synthetic oligonucleotide
  Description of Combined DNA/RNA Molecule: Synthetic oligonucleotide
ucugugcaagugcccaagauccutt

SEQ ID NO: 1861 - DNA, 25 bp, Artificial Sequence
  Description of Artificial Sequence: Synthetic oligonucleotide
  Description of Combined DNA/RNA Molecule: Synthetic oligonucleotide
cugugcaagugcccaagauccuutc

SEQ ID NO: 1862 - DNA, 25 bp, Artificial Sequence
  Description of Artificial Sequence: Synthetic oligonucleotide
  Description of Combined DNA/RNA Molecule: Synthetic oligonucleotide
ugugcaagugcccaagauccuuuct

SEQ ID NO: 1863 - DNA, 25 bp, Artificial Sequence
  Description of Artificial Sequence: Synthetic oligonucleotide
  Description of Combined DNA/RNA Molecule: Synthetic oligonucleotide
gugcaagugcccaagauccuuuctg

SEQ ID NO: 1864 - DNA, 25 bp, Artificial Sequence
  Description of Artificial Sequence: Synthetic oligonucleotide
  Description of Combined DNA/RNA Molecule: Synthetic oligonucleotide
ugcaagugcccaagauccuuucugg

SEQ ID NO: 1865 - DNA, 25 bp, Artificial Sequence
  Description of Artificial Sequence: Synthetic oligonucleotide
  Description of Combined DNA/RNA Molecule: Synthetic oligonucleotide
gcaagugcccaagauccuuucuggg

SEQ ID NO: 1866 - DNA, 25 bp, Artificial Sequence
  Description of Artificial Sequence: Synthetic oligonucleotide
  Description of Combined DNA/RNA Molecule: Synthetic oligonucleotide
caagugcccaagauccuuucuggga

SEQ ID NO: 1867 - DNA, 25 bp, Artificial Sequence
  Description of Artificial Sequence: Synthetic oligonucleotide
  Description of Combined DNA/RNA Molecule: Synthetic oligonucleotide
aagugcccaagauccuuucugggaa

SEQ ID NO: 1868 - DNA, 25 bp, Artificial Sequence
  Description of Artificial Sequence: Synthetic oligonucleotide
  Description of Combined DNA/RNA Molecule: Synthetic oligonucleotide
agugcccaagauccuuucugggaaa

SEQ ID NO: 1869 - DNA, 25 bp, Artificial Sequence
  Description of Artificial Sequence: Synthetic oligonucleotide
  Description of Combined DNA/RNA Molecule: Synthetic oligonucleotide
gugcccaagauccuuucugggaaag

SEQ ID NO: 1870 - DNA, 25 bp, Artificial Sequence
  Description of Artificial Sequence: Synthetic oligonucleotide
  Description of Combined DNA/RNA Molecule: Synthetic oligonucleotide
ugcccaagauccuuucugggaaagt

SEQ ID NO: 1871 - DNA, 25 bp, Artificial Sequence
  Description of Artificial Sequence: Synthetic oligonucleotide
  Description of Combined DNA/RNA Molecule: Synthetic oligonucleotide
gcccaagauccuuucugggaaagtc

SEQ ID NO: 1872 - DNA, 25 bp, Artificial Sequence
  Description of Artificial Sequence: Synthetic oligonucleotide
  Description of Combined DNA/RNA Molecule: Synthetic oligonucleotide
cccaagauccuuucugggaaaguca

SEQ ID NO: 1873 - DNA, 25 bp, Artificial Sequence
  Description of Artificial Sequence: Synthetic oligonucleotide
  Description of Combined DNA/RNA Molecule: Synthetic oligonucleotide
ccaagauccuuucugggaaagucaa

SEQ ID NO: 1874 - DNA, 25 bp, Artificial Sequence
  Description of Artificial Sequence: Synthetic oligonucleotide
  Description of Combined DNA/RNA Molecule: Synthetic oligonucleotide
caagauccuuucugggaaagucaag

SEQ ID NO: 1875 - DNA, 25 bp, Artificial Sequence
  Description of Artificial Sequence: Synthetic oligonucleotide
  Description of Combined DNA/RNA Molecule: Synthetic oligonucleotide
aagauccuuucugggaaagucaagc

SEQ ID NO: 1876 - DNA, 25 bp, Artificial Sequence
  Description of Artificial Sequence: Synthetic oligonucleotide
  Description of Combined DNA/RNA Molecule: Synthetic oligonucleotide
agauccuuucugggaaagucaagcc

SEQ ID NO: 1877 - DNA, 25 bp, Artificial Sequence
  Description of Artificial Sequence: Synthetic oligonucleotide
  Description of Combined DNA/RNA Molecule: Synthetic oligonucleotide
gauccuuucugggaaagucaagccc

SEQ ID NO: 1878 - DNA, 25 bp, Artificial Sequence
  Description of Artificial Sequence: Synthetic oligonucleotide
  Description of Combined DNA/RNA Molecule: Synthetic oligonucleotide
auccuuucugggaaagucaagccca

SEQ ID NO: 1879 - DNA, 25 bp, Artificial Sequence
  Description of Artificial Sequence: Synthetic oligonucleotide
  Description of Combined DNA/RNA Molecule: Synthetic oligonucleotide
uccuuucugggaaagucaagcccat

SEQ ID NO: 1880 - DNA, 25 bp, Artificial Sequence
  Description of Artificial Sequence: Synthetic oligonucleotide
  Description of Combined DNA/RNA Molecule: Synthetic oligonucleotide
ccuuucugggaaagucaagcccatc

SEQ ID NO: 1881 - DNA, 25 bp, Artificial Sequence
  Description of Artificial Sequence: Synthetic oligonucleotide
  Description of Combined DNA/RNA Molecule: Synthetic oligonucleotide
cuuucugggaaagucaagcccauct

SEQ ID NO: 1882 - DNA, 25 bp, Artificial Sequence
  Description of Artificial Sequence: Synthetic oligonucleotide
  Description of Combined DNA/RNA Molecule: Synthetic oligonucleotide
uuucugggaaagucaagcccaucta

SEQ ID NO: 1883 - DNA, 25 bp, Artificial Sequence
  Description of Artificial Sequence: Synthetic oligonucleotide
  Description of Combined DNA/RNA Molecule: Synthetic oligonucleotide
uucugggaaagucaagcccaucuat

SEQ ID NO: 1884 - DNA, 25 bp, Artificial Sequence
  Description of Artificial Sequence: Synthetic oligonucleotide
  Description of Combined DNA/RNA Molecule: Synthetic oligonucleotide
ucugggaaagucaagcccaucuatt

SEQ ID NO: 1885 - DNA, 25 bp, Artificial Sequence
  Description of Artificial Sequence: Synthetic oligonucleotide
  Description of Combined DNA/RNA Molecule: Synthetic oligonucleotide
cugggaaagucaagcccaucuautt

SEQ ID NO: 1886 - DNA, 25 bp, Artificial Sequence
  Description of Artificial Sequence: Synthetic oligonucleotide
  Description of Combined DNA/RNA Molecule: Synthetic oligonucleotide
ugggaaagucaagcccaucuauutc

SEQ ID NO: 1887 - DNA, 25 bp, Artificial Sequence
  Description of Artificial Sequence: Synthetic oligonucleotide
  Description of Combined DNA/RNA Molecule: Synthetic oligonucleotide
gggaaagucaagcccaucuauuucc

SEQ ID NO: 1888 - DNA, 25 bp, Artificial Sequence
  Description of Artificial Sequence: Synthetic oligonucleotide
  Description of Combined DNA/RNA Molecule: Synthetic oligonucleotide
ggaaagucaagcccaucuauuucca

SEQ ID NO: 1889 - DNA, 25 bp, Artificial Sequence
  Description of Artificial Sequence: Synthetic oligonucleotide
  Description of Combined DNA/RNA Molecule: Synthetic oligonucleotide
gaaagucaagcccaucuauuuccac

SEQ ID NO: 1890 - DNA, 25 bp, Artificial Sequence
  Description of Artificial Sequence: Synthetic oligonucleotide
  Description of Combined DNA/RNA Molecule: Synthetic oligonucleotide
aaagucaagcccaucuauuuccaca

SEQ ID NO: 1891 - DNA, 25 bp, Artificial Sequence
  Description of Artificial Sequence: Synthetic oligonucleotide
  Description of Combined DNA/RNA Molecule: Synthetic oligonucleotide
aagucaagcccaucuauuuccacac

SEQ ID NO: 1892 - DNA, 25 bp, Artificial Sequence
  Description of Artificial Sequence: Synthetic oligonucleotide
  Description of Combined DNA/RNA Molecule: Synthetic oligonucleotide
cagaugucuucugccuguuauaact

SEQ ID NO: 1893 - DNA, 25 bp, Artificial Sequence
  Description of Artificial Sequence: Synthetic oligonucleotide
  Description of Combined DNA/RNA Molecule: Synthetic oligonucleotide
agaugucuucugccuguuauaactc

SEQ ID NO: 1894 - DNA, 25 bp, Artificial Sequence
  Description of Artificial Sequence: Synthetic oligonucleotide
  Description of Combined DNA/RNA Molecule: Synthetic oligonucleotide
gaugucuucugccuguuauaacuct

SEQ ID NO: 1895 - DNA, 25 bp, Artificial Sequence
  Description of Artificial Sequence: Synthetic oligonucleotide
  Description of Combined DNA/RNA Molecule: Synthetic oligonucleotide
augucuucugccuguuauaacuctg

SEQ ID NO: 1896 - DNA, 25 bp, Artificial Sequence
  Description of Artificial Sequence: Synthetic oligonucleotide
  Description of Combined DNA/RNA Molecule: Synthetic oligonucleotide
ggaauuuccucuauugauguacagt

SEQ ID NO: 1897 - DNA, 25 bp, Artificial Sequence
  Description of Artificial Sequence: Synthetic oligonucleotide
  Description of Combined DNA/RNA Molecule: Synthetic oligonucleotide
gcugggcuuuuuuuuucucuuuctc

SEQ ID NO: 1898 - DNA, 25 bp, Artificial Sequence
  Description of Artificial Sequence: Synthetic oligonucleotide
  Description of Combined DNA/RNA Molecule: Synthetic oligonucleotide
cugggcuuuuuuuuucucuuucuct

SEQ ID NO: 1899 - DNA, 25 bp, Artificial Sequence
  Description of Artificial Sequence: Synthetic oligonucleotide
  Description of Combined DNA/RNA Molecule: Synthetic oligonucleotide
uuuuuuuuucucuuucucuccuutc

SEQ ID NO: 1900 - DNA, 25 bp, Artificial Sequence
  Description of Artificial Sequence: Synthetic oligonucleotide
  Description of Combined DNA/RNA Molecule: Synthetic oligonucleotide
uuuucucuuucucuccuuucuuutt

SEQ ID NO: 1901 - DNA, 25 bp, Artificial Sequence
  Description of Artificial Sequence: Synthetic oligonucleotide
  Description of Combined DNA/RNA Molecule: Synthetic oligonucleotide
uuuuucuucuucccucccuaucuaa

SEQ ID NO: 1902 - DNA, 25 bp, Artificial Sequence
  Description of Artificial Sequence: Synthetic oligonucleotide
  Description of Combined DNA/RNA Molecule: Synthetic oligonucleotide
uuguaugccuuuaaaucugugauga

SEQ ID NO: 1903 - DNA, 25 bp, Artificial Sequence
  Description of Artificial Sequence: Synthetic oligonucleotide
  Description of Combined DNA/RNA Molecule: Synthetic oligonucleotide
ugcuuguuuacagcacuacucugtg

SEQ ID NO: 1904 - DNA, 25 bp, Artificial Sequence
  Description of Artificial Sequence: Synthetic oligonucleotide
  Description of Combined DNA/RNA Molecule: Synthetic oligonucleotide
agagagcuaagauuaucuggggaaa

SEQ ID NO: 1905 - DNA, 25 bp, Artificial Sequence
  Description of Artificial Sequence: Synthetic oligonucleotide
  Description of Combined DNA/RNA Molecule: Synthetic oligonucleotide
ggaaaucaaaacaaaaacaagcaaa

SEQ ID NO: 1906 - RNA, 27 nt, Artificial Sequence
  Description of Artificial Sequence: Synthetic oligonucleotide
cgucccgcucucccagcaagcuggcuc

SEQ ID NO: 1907 - RNA, 27 nt, Artificial Sequence
  Description of Artificial Sequence: Synthetic oligonucleotide
aagaggcguuggcugucgcuggagccg

SEQ ID NO: 1908 - RNA, 27 nt, Artificial Sequence
  Description of Artificial Sequence: Synthetic oligonucleotide
ccgccgcgcugcaagaggcguuggcug

SEQ ID NO: 1909 - RNA, 27 nt, Artificial Sequence
  Description of Artificial Sequence: Synthetic oligonucleotide
cuucgaagccgccgcgcugcaagaggc

SEQ ID NO: 1910 - RNA, 27 nt, Artificial Sequence
  Description of Artificial Sequence: Synthetic oligonucleotide
cggcggcuucgaagccgccgcgcugca

SEQ ID NO: 1911 - RNA, 27 nt, Artificial Sequence
  Description of Artificial Sequence: Synthetic oligonucleotide
aaagggcagcuccgggcggcggcuucg

SEQ ID NO: 1912 - RNA, 27 nt, Artificial Sequence
  Description of Artificial Sequence: Synthetic oligonucleotide
aagaggaaagggcagcuccgggcggcg

SEQ ID NO: 1913 - RNA, 27 nt, Artificial Sequence
  Description of Artificial Sequence: Synthetic oligonucleotide
agucuuuagcagcuuuuaaaaacuuca

SEQ ID NO: 1914 - RNA, 27 nt, Artificial Sequence
  Description of Artificial Sequence: Synthetic oligonucleotide
cugaggcagcugcgggagagaagacgg

SEQ ID NO: 1915 - RNA, 27 nt, Artificial Sequence
  Description of Artificial Sequence: Synthetic oligonucleotide
gagaguagccgacugaggcagcugcgg

SEQ ID NO: 1916 - RNA, 27 nt, Artificial Sequence
  Description of Artificial Sequence: Synthetic oligonucleotide
cagcuagcucgcccgcucgcagccaaa

SEQ ID NO: 1917 - RNA, 27 nt, Artificial Sequence
  Description of Artificial Sequence: Synthetic oligonucleotide
cuuugcaaugugcagcuagcucgcccg

SEQ ID NO: 1918 - RNA, 27 nt, Artificial Sequence
  Description of Artificial Sequence: Synthetic oligonucleotide
gggaaggcaggaggagguggagagaga

SEQ ID NO: 1919 - RNA, 27 nt, Artificial Sequence
  Description of Artificial Sequence: Synthetic oligonucleotide
acugccuuuucaucuuuugaucucugg

SEQ ID NO: 1920 - RNA, 27 nt, Artificial Sequence
  Description of Artificial Sequence: Synthetic oligonucleotide
uuuguuuguuuuguuuuuuggcuacug

SEQ ID NO: 1921 - RNA, 27 nt, Artificial Sequence
  Description of Artificial Sequence: Synthetic oligonucleotide
uuuguuuuuguuuguuuuguuuuuugg

SEQ ID NO: 1922 - RNA, 27 nt, Artificial Sequence
  Description of Artificial Sequence: Synthetic oligonucleotide
cggcuuuuuuguuuuuguuuguuuugu

SEQ ID NO: 1923 - RNA, 27 nt, Artificial Sequence
  Description of Artificial Sequence: Synthetic oligonucleotide
cuuuuucuuuuauuucggcuuuuuugu

SEQ ID NO: 1924 - RNA, 27 nt, Artificial Sequence
  Description of Artificial Sequence: Synthetic oligonucleotide
guuauuaucuuuuucuuuuauuucggc

SEQ ID NO: 1925 - RNA, 27 nt, Artificial Sequence
  Description of Artificial Sequence: Synthetic oligonucleotide
uaagaacugaguuauuaucuuuuucuu

SEQ ID NO: 1926 - RNA, 27 nt, Artificial Sequence
  Description of Artificial Sequence: Synthetic oligonucleotide
gcaaauaagaacugaguuauuaucuuu

SEQ ID NO: 1927 - RNA, 27 nt, Artificial Sequence
  Description of Artificial Sequence: Synthetic oligonucleotide
ggugcaaauaagaacugaguuauuauc

SEQ ID NO: 1928 - RNA, 27 nt, Artificial Sequence
  Description of Artificial Sequence: Synthetic oligonucleotide
cuuaaaagaaaaaaacaaaauccucca

SEQ ID NO: 1929 - RNA, 27 nt, Artificial Sequence
  Description of Artificial Sequence: Synthetic oligonucleotide
cagaucuuaaaagaaaaaaacaaaauc

SEQ ID NO: 1930 - RNA, 27 nt, Artificial Sequence
  Description of Artificial Sequence: Synthetic oligonucleotide
gaugcccagaucuuaaaagaaaaaaac

SEQ ID NO: 1931 - RNA, 27 nt, Artificial Sequence
  Description of Artificial Sequence: Synthetic oligonucleotide
cuugaaggguagauucaaaagaugccc

SEQ ID NO: 1932 - RNA, 27 nt, Artificial Sequence
  Description of Artificial Sequence: Synthetic oligonucleotide
gggagcaaccacgcaaaaagcgcucug

SEQ ID NO: 1933 - RNA, 27 nt, Artificial Sequence
  Description of Artificial Sequence: Synthetic oligonucleotide
cuugcgggagcaaccacgcaaaaagcg

SEQ ID NO: 1934 - RNA, 27 nt, Artificial Sequence
  Description of Artificial Sequence: Synthetic oligonucleotide
ugcgggaagcuccagagaaggaaacuu

SEQ ID NO: 1935 - RNA, 27 nt, Artificial Sequence
  Description of Artificial Sequence: Synthetic oligonucleotide
cagcuagcugcccaccugcgggaagcu

SEQ ID NO: 1936 - RNA, 27 nt, Artificial Sequence
  Description of Artificial Sequence: Synthetic oligonucleotide
cgguagucgcugcagcuagcugcccac

SEQ ID NO: 1937 - RNA, 27 nt, Artificial Sequence
  Description of Artificial Sequence: Synthetic oligonucleotide
agacccuucccagcccuaacugcacuu

SEQ ID NO: 1938 - RNA, 27 nt, Artificial Sequence
  Description of Artificial Sequence: Synthetic oligonucleotide
uagacccuucccagcccuaacugcacu

SEQ ID NO: 1939 - RNA, 27 nt, Artificial Sequence
  Description of Artificial Sequence: Synthetic oligonucleotide
guagacccuucccagcccuaacugcac

SEQ ID NO: 1940 - RNA, 27 nt, Artificial Sequence
  Description of Artificial Sequence: Synthetic oligonucleotide
gguagacccuucccagcccuaacugca

SEQ ID NO: 1941 - RNA, 27 nt, Artificial Sequence
  Description of Artificial Sequence: Synthetic oligonucleotide
ggguagacccuucccagcccuaacugc

SEQ ID NO: 1942 - RNA, 27 nt, Artificial Sequence
  Description of Artificial Sequence: Synthetic oligonucleotide
aggguagacccuucccagcccuaacug

SEQ ID NO: 1943 - RNA, 27 nt, Artificial Sequence
  Description of Artificial Sequence: Synthetic oligonucleotide
gaggguagacccuucccagcccuaacu

SEQ ID NO: 1944 - RNA, 27 nt, Artificial Sequence
  Description of Artificial Sequence: Synthetic oligonucleotide
cgaggguagacccuucccagcccuaac

SEQ ID NO: 1945 - RNA, 27 nt, Artificial Sequence
  Description of Artificial Sequence: Synthetic oligonucleotide
ccgaggguagacccuucccagcccuaa

SEQ ID NO: 1946 - RNA, 27 nt, Artificial Sequence
  Description of Artificial Sequence: Synthetic oligonucleotide
gccgaggguagacccuucccagcccua

SEQ ID NO: 1947 - RNA, 27 nt, Artificial Sequence
  Description of Artificial Sequence: Synthetic oligonucleotide
ggccgaggguagacccuucccagcccu

SEQ ID NO: 1948 - RNA, 27 nt, Artificial Sequence
  Description of Artificial Sequence: Synthetic oligonucleotide
gcacgcucuggaacagauucuggaaag

SEQ ID NO: 1949 - RNA, 27 nt, Artificial Sequence
  Description of Artificial Sequence: Synthetic oligonucleotide
cgcacgcucuggaacagauucuggaaa

SEQ ID NO: 1950 - RNA, 27 nt, Artificial Sequence
  Description of Artificial Sequence: Synthetic oligonucleotide
gcgcacgcucuggaacagauucuggaa

SEQ ID NO: 1951 - RNA, 27 nt, Artificial Sequence
  Description of Artificial Sequence: Synthetic oligonucleotide
cgcgcacgcucuggaacagauucugga

SEQ ID NO: 1952 - RNA, 27 nt, Artificial Sequence
  Description of Artificial Sequence: Synthetic oligonucleotide
ucgcgcacgcucuggaacagauucugg

SEQ ID NO: 1953 - RNA, 27 nt, Artificial Sequence
  Description of Artificial Sequence: Synthetic oligonucleotide
uucgcgcacgcucuggaacagauucug

SEQ ID NO: 1954 - RNA, 27 nt, Artificial Sequence
  Description of Artificial Sequence: Synthetic oligonucleotide
cuucgcgcacgcucuggaacagauucu

SEQ ID NO: 1955 - RNA, 27 nt, Artificial Sequence
  Description of Artificial Sequence: Synthetic oligonucleotide
acuucgcgcacgcucuggaacagauuc

SEQ ID NO: 1956 - RNA, 27 nt, Artificial Sequence
  Description of Artificial Sequence: Synthetic oligonucleotide
cacuucgcgcacgcucuggaacagauu

SEQ ID NO: 1957 - RNA, 27 nt, Artificial Sequence
  Description of Artificial Sequence: Synthetic oligonucleotide
ucacuucgcgcacgcucuggaacagau

SEQ ID NO: 1958 - RNA, 27 nt, Artificial Sequence
  Description of Artificial Sequence: Synthetic oligonucleotide
aucacuucgcgcacgcucuggaacaga

SEQ ID NO: 1959 - RNA, 27 nt, Artificial Sequence
  Description of Artificial Sequence: Synthetic oligonucleotide
gaucacuucgcgcacgcucuggaacag

SEQ ID NO: 1960 - RNA, 27 nt, Artificial Sequence
  Description of Artificial Sequence: Synthetic oligonucleotide
ggaucacuucgcgcacgcucuggaaca

SEQ ID NO: 1961 - RNA, 27 nt, Artificial Sequence
  Description of Artificial Sequence: Synthetic oligonucleotide
cugcugcagcagcagcaaacuggcgcc

SEQ ID NO: 1962 - RNA, 27 nt, Artificial Sequence
  Description of Artificial Sequence: Synthetic oligonucleotide
cugcugcugcugcugcagcagcagcaa

SEQ ID NO: 1963 - RNA, 27 nt, Artificial Sequence
  Description of Artificial Sequence: Synthetic oligonucleotide
ccacggcggcuccaggcucugggacgc

SEQ ID NO: 1964 - RNA, 27 nt, Artificial Sequence
  Description of Artificial Sequence: Synthetic oligonucleotide
gaggugcuggcagcugcugcggcagcc

SEQ ID NO: 1965 - RNA, 27 nt, Artificial Sequence
  Description of Artificial Sequence: Synthetic oligonucleotide
cguccggaggugcuggcagcugcugcg

SEQ ID NO: 1966 - RNA, 27 nt, Artificial Sequence
  Description of Artificial Sequence: Synthetic oligonucleotide
gggcccagcagggacaacguggauggg

SEQ ID NO: 1967 - RNA, 27 nt, Artificial Sequence
  Description of Artificial Sequence: Synthetic oligonucleotide
ggucagcggagcagcugcuuaagccgg

SEQ ID NO: 1968 - RNA, 27 nt, Artificial Sequence
  Description of Artificial Sequence: Synthetic oligonucleotide
aggucagcggagcagcugcuuaagccg

SEQ ID NO: 1969 - RNA, 27 nt, Artificial Sequence
  Description of Artificial Sequence: Synthetic oligonucleotide
cuuuaaggucagcggagcagcugcuua

SEQ ID NO: 1970 - RNA, 27 nt, Artificial Sequence
  Description of Artificial Sequence: Synthetic oligonucleotide
cugcugcuguugcugaaggaguugcau

SEQ ID NO: 1971 - RNA, 27 nt, Artificial Sequence
  Description of Artificial Sequence: Synthetic oligonucleotide
caacuccuuggcguugucagaaauggu

SEQ ID NO: 1972 - RNA, 27 nt, Artificial Sequence
  Description of Artificial Sequence: Synthetic oligonucleotide
cacagcggguggaacucccaaaagugg

SEQ ID NO: 1973 - RNA, 27 nt, Artificial Sequence
  Description of Artificial Sequence: Synthetic oligonucleotide
cagcaguaucuucagugcucuugccug

SEQ ID NO: 1974 - RNA, 27 nt, Artificial Sequence
  Description of Artificial Sequence: Synthetic oligonucleotide
cggagcucccugcugcagcgcugccag

SEQ ID NO: 1975 - RNA, 27 nt, Artificial Sequence
  Description of Artificial Sequence: Synthetic oligonucleotide
caguggaaaguuguaguagucgcgacu

SEQ ID NO: 1976 - RNA, 27 nt, Artificial Sequence
  Description of Artificial Sequence: Synthetic oligonucleotide
ccaguggaaaguuguaguagucgcgac

SEQ ID NO: 1977 - RNA, 27 nt, Artificial Sequence
  Description of Artificial Sequence: Synthetic oligonucleotide
gccaguggaaaguuguaguagucgcga

SEQ ID NO: 1978 - RNA, 27 nt, Artificial Sequence
  Description of Artificial Sequence: Synthetic oligonucleotide
cagcggguucuccagcuugaugcgagc

SEQ ID NO: 1979 - RNA, 27 nt, Artificial Sequence
  Description of Artificial Sequence: Synthetic oligonucleotide
gccgcccaggcgcugccguaguccagc

SEQ ID NO: 1980 - RNA, 27 nt, Artificial Sequence
  Description of Artificial Sequence: Synthetic oligonucleotide
agccgcccaggcgcugccguaguccag

SEQ ID NO: 1981 - RNA, 27 nt, Artificial Sequence
  Description of Artificial Sequence: Synthetic oligonucleotide
cagccgcccaggcgcugccguagucca

SEQ ID NO: 1982 - RNA, 27 nt, Artificial Sequence
  Description of Artificial Sequence: Synthetic oligonucleotide
gcagccgcccaggcgcugccguagucc

SEQ ID NO: 1983 - RNA, 27 nt, Artificial Sequence
  Description of Artificial Sequence: Synthetic oligonucleotide
gaaccgggucccgcugcacccgcgcca

SEQ ID NO: 1984 - RNA, 27 nt, Artificial Sequence
  Description of Artificial Sequence: Synthetic oligonucleotide
ugaagucgcuuuccuggcccgccagcc

SEQ ID NO: 1985 - RNA, 27 nt, Artificial Sequence
  Description of Artificial Sequence: Synthetic oligonucleotide
acucugcucaccaugccgccaggguac

SEQ ID NO: 1986 - RNA, 27 nt, Artificial Sequence
  Description of Artificial Sequence: Synthetic oligonucleotide
guaagguccggaguagcuauccaucca

SEQ ID NO: 1987 - RNA, 27 nt, Artificial Sequence
  Description of Artificial Sequence: Synthetic oligonucleotide
cuccacagaucaggcaggucuucuggg

SEQ ID NO: 1988 - RNA, 27 nt, Artificial Sequence
  Description of Artificial Sequence: Synthetic oligonucleotide
ucuccacagaucaggcaggucuucugg

SEQ ID NO: 1989 - RNA, 27 nt, Artificial Sequence
  Description of Artificial Sequence: Synthetic oligonucleotide
aucuccacagaucaggcaggucuucug

SEQ ID NO: 1990 - RNA, 27 nt, Artificial Sequence
  Description of Artificial Sequence: Synthetic oligonucleotide
caucuccacagaucaggcaggucuucu

SEQ ID NO: 1991 - RNA, 27 nt, Artificial Sequence
  Description of Artificial Sequence: Synthetic oligonucleotide
ucaucuccacagaucaggcaggucuuc

SEQ ID NO: 1992 - RNA, 27 nt, Artificial Sequence
  Description of Artificial Sequence: Synthetic oligonucleotide
uucaucuccacagaucaggcaggucuu

SEQ ID NO: 1993 - RNA, 27 nt, Artificial Sequence
  Description of Artificial Sequence: Synthetic oligonucleotide
cuucaucuccacagaucaggcaggucu

SEQ ID NO: 1994 - RNA, 27 nt, Artificial Sequence
  Description of Artificial Sequence: Synthetic oligonucleotide
gcuucaucuccacagaucaggcagguc

SEQ ID NO: 1995 - RNA, 27 nt, Artificial Sequence
  Description of Artificial Sequence: Synthetic oligonucleotide
agcuucaucuccacagaucaggcaggu

SEQ ID NO: 1996 - RNA, 27 nt, Artificial Sequence
  Description of Artificial Sequence: Synthetic oligonucleotide
aagcuucaucuccacagaucaggcagg

SEQ ID NO: 1997 - RNA, 27 nt, Artificial Sequence
  Description of Artificial Sequence: Synthetic oligonucleotide
gaagcuucaucuccacagaucaggcag

SEQ ID NO: 1998 - RNA, 27 nt, Artificial Sequence
  Description of Artificial Sequence: Synthetic oligonucleotide
agaagcuucaucuccacagaucaggca

SEQ ID NO: 1999 - RNA, 27 nt, Artificial Sequence
  Description of Artificial Sequence: Synthetic oligonucleotide
cagaagcuucaucuccacagaucaggc

SEQ ID NO: 2000 - RNA, 27 nt, Artificial Sequence
  Description of Artificial Sequence: Synthetic oligonucleotide
ccagaagcuucaucuccacagaucagg

SEQ ID NO: 2001 - RNA, 27 nt, Artificial Sequence
  Description of Artificial Sequence: Synthetic oligonucleotide
cccagaagcuucaucuccacagaucag

SEQ ID NO: 2002 - RNA, 27 nt, Artificial Sequence
  Description of Artificial Sequence: Synthetic oligonucleotide
acccagaagcuucaucuccacagauca

SEQ ID NO: 2003 - RNA, 27 nt, Artificial Sequence
  Description of Artificial Sequence: Synthetic oligonucleotide
cacccagaagcuucaucuccacagauc

SEQ ID NO: 2004 - RNA, 27 nt, Artificial Sequence
  Description of Artificial Sequence: Synthetic oligonucleotide
acacccagaagcuucaucuccacagau

SEQ ID NO: 2005 - RNA, 27 nt, Artificial Sequence
  Description of Artificial Sequence: Synthetic oligonucleotide
gacacccagaagcuucaucuccacaga

SEQ ID NO: 2006 - RNA, 27 nt, Artificial Sequence
  Description of Artificial Sequence: Synthetic oligonucleotide
ugacacccagaagcuucaucuccacag

SEQ ID NO: 2007 - RNA, 27 nt, Artificial Sequence
  Description of Artificial Sequence: Synthetic oligonucleotide
gagagcuccauagugacacccagaagc

SEQ ID NO: 2008 - RNA, 27 nt, Artificial Sequence
  Description of Artificial Sequence: Synthetic oligonucleotide
uugcagcuuccacaugugagagcucca

SEQ ID NO: 2009 - RNA, 27 nt, Artificial Sequence
  Description of Artificial Sequence: Synthetic oligonucleotide
cucuuuugaagaagaccuugcagcuuc

SEQ ID NO: 2010 - RNA, 27 nt, Artificial Sequence
  Description of Artificial Sequence: Synthetic oligonucleotide
gcucuuuugaagaagaccuugcagcuu

SEQ ID NO: 2011 - RNA, 27 nt, Artificial Sequence
  Description of Artificial Sequence: Synthetic oligonucleotide
ggcucuuuugaagaagaccuugcagcu

SEQ ID NO: 2012 - RNA, 27 nt, Artificial Sequence
  Description of Artificial Sequence: Synthetic oligonucleotide
cggcucuuuugaagaagaccuugcagc

SEQ ID NO: 2013 - RNA, 27 nt, Artificial Sequence
  Description of Artificial Sequence: Synthetic oligonucleotide
gcggcucuuuugaagaagaccuugcag

SEQ ID NO: 2014 - RNA, 27 nt, Artificial Sequence
  Description of Artificial Sequence: Synthetic oligonucleotide
agcggcucuuuugaagaagaccuugca

SEQ ID NO: 2015 - RNA, 27 nt, Artificial Sequence
  Description of Artificial Sequence: Synthetic oligonucleotide
cagcggcucuuuugaagaagaccuugc

SEQ ID NO: 2016 - RNA, 27 nt, Artificial Sequence
  Description of Artificial Sequence: Synthetic oligonucleotide
ucagcggcucuuuugaagaagaccuug

SEQ ID NO: 2017 - RNA, 27 nt, Artificial Sequence
  Description of Artificial Sequence: Synthetic oligonucleotide
uucagcggcucuuuugaagaagaccuu

SEQ ID NO: 2018 - RNA, 27 nt, Artificial Sequence
  Description of Artificial Sequence: Synthetic oligonucleotide
cuucagcggcucuuuugaagaagaccu

SEQ ID NO: 2019 - RNA, 27 nt, Artificial Sequence
  Description of Artificial Sequence: Synthetic oligonucleotide
ccuucagcggcucuuuugaagaagacc

SEQ ID NO: 2020 - RNA, 27 nt, Artificial Sequence
  Description of Artificial Sequence: Synthetic oligonucleotide
cccuucagcggcucuuuugaagaagac

SEQ ID NO: 2021 - RNA, 27 nt, Artificial Sequence
  Description of Artificial Sequence: Synthetic oligonucleotide
ucccuucagcggcucuuuugaagaaga

SEQ ID NO: 2022 - RNA, 27 nt, Artificial Sequence
  Description of Artificial Sequence: Synthetic oligonucleotide
uucccuucagcggcucuuuugaagaag

SEQ ID NO: 2023 - RNA, 27 nt, Artificial Sequence
  Description of Artificial Sequence: Synthetic oligonucleotide
uuucccuucagcggcucuuuugaagaa

SEQ ID NO: 2024 - RNA, 27 nt, Artificial Sequence
  Description of Artificial Sequence: Synthetic oligonucleotide
guuucccuucagcggcucuuuugaaga

SEQ ID NO: 2025 - RNA, 27 nt, Artificial Sequence
  Description of Artificial Sequence: Synthetic oligonucleotide
uguuucccuucagcggcucuuuugaag

SEQ ID NO: 2026 - RNA, 27 nt, Artificial Sequence
  Description of Artificial Sequence: Synthetic oligonucleotide
cuguuucccuucagcggcucuuuugaa

SEQ ID NO: 2027 - RNA, 27 nt, Artificial Sequence
  Description of Artificial Sequence: Synthetic oligonucleotide
ucuguuucccuucagcggcucuuuuga

SEQ ID NO: 2028 - RNA, 27 nt, Artificial Sequence
  Description of Artificial Sequence: Synthetic oligonucleotide
uucuguuucccuucagcggcucuuuug

SEQ ID NO: 2029 - RNA, 27 nt, Artificial Sequence
  Description of Artificial Sequence: Synthetic oligonucleotide
cuucuguuucccuucagcggcucuuuu

SEQ ID NO: 2030 - RNA, 27 nt, Artificial Sequence
  Description of Artificial Sequence: Synthetic oligonucleotide
acuucuguuucccuucagcggcucuuu

SEQ ID NO: 2031 - RNA, 27 nt, Artificial Sequence
  Description of Artificial Sequence: Synthetic oligonucleotide
uacuucuguuucccuucagcggcucuu

SEQ ID NO: 2032 - RNA, 27 nt, Artificial Sequence
  Description of Artificial Sequence: Synthetic oligonucleotide
guacuucuguuucccuucagcggcucu

SEQ ID NO: 2033 - RNA, 27 nt, Artificial Sequence
  Description of Artificial Sequence: Synthetic oligonucleotide
gguacuucuguuucccuucagcggcuc

SEQ ID NO: 2034 - RNA, 27 nt, Artificial Sequence
  Description of Artificial Sequence: Synthetic oligonucleotide
agguacuucuguuucccuucagcggcu

SEQ ID NO: 2035 - RNA, 27 nt, Artificial Sequence
  Description of Artificial Sequence: Synthetic oligonucleotide
acagguacuucuguuucccuucagcgg

SEQ ID NO: 2036 - RNA, 27 nt, Artificial Sequence
  Description of Artificial Sequence: Synthetic oligonucleotide
cacagguacuucuguuucccuucagcg

SEQ ID NO: 2037 - RNA, 27 nt, Artificial Sequence
  Description of Artificial Sequence: Synthetic oligonucleotide
gugcaaucauuucugcuggcgcacagg

SEQ ID NO: 2038 - RNA, 27 nt, Artificial Sequence
  Description of Artificial Sequence: Synthetic oligonucleotide
auuuaucaauagugcaaucauuucugc

SEQ ID NO: 2039 - RNA, 27 nt, Artificial Sequence
  Description of Artificial Sequence: Synthetic oligonucleotide
ucggaauuuaucaauagugcaaucauu

SEQ ID NO: 2040 - RNA, 27 nt, Artificial Sequence
  Description of Artificial Sequence: Synthetic oligonucleotide
uuuuuccuucggaauuuaucaauagug

SEQ ID NO: 2041 - RNA, 27 nt, Artificial Sequence
  Description of Artificial Sequence: Synthetic oligonucleotide
ucaucccugcuucauaacauuuccgaa

SEQ ID NO: 2042 - RNA, 27 nt, Artificial Sequence
  Description of Artificial Sequence: Synthetic oligonucleotide
gucaucccugcuucauaacauuuccga

SEQ ID NO: 2043 - RNA, 27 nt, Artificial Sequence
  Description of Artificial Sequence: Synthetic oligonucleotide
agucaucccugcuucauaacauuuccg

SEQ ID NO: 2044 - RNA, 27 nt, Artificial Sequence
  Description of Artificial Sequence: Synthetic oligonucleotide
gagucaucccugcuucauaacauuucc

SEQ ID NO: 2045 - RNA, 27 nt, Artificial Sequence
  Description of Artificial Sequence: Synthetic oligonucleotide
agagucaucccugcuucauaacauuuc

SEQ ID NO: 2046 - RNA, 27 nt, Artificial Sequence
  Description of Artificial Sequence: Synthetic oligonucleotide
cagagucaucccugcuucauaacauuu

SEQ ID NO: 2047 - RNA, 27 nt, Artificial Sequence
  Description of Artificial Sequence: Synthetic oligonucleotide
ccagagucaucccugcuucauaacauu

SEQ ID NO: 2048 - RNA, 27 nt, Artificial Sequence
  Description of Artificial Sequence: Synthetic oligonucleotide
cccagagucaucccugcuucauaacau

SEQ ID NO: 2049 - RNA, 27 nt, Artificial Sequence
  Description of Artificial Sequence: Synthetic oligonucleotide
ucccagagucaucccugcuucauaaca

SEQ ID NO: 2050 - RNA, 27 nt, Artificial Sequence
  Description of Artificial Sequence: Synthetic oligonucleotide
cucccagagucaucccugcuucauaac

SEQ ID NO: 2051 - RNA, 27 nt, Artificial Sequence
  Description of Artificial Sequence: Synthetic oligonucleotide
gcucccagagucaucccugcuucauaa

SEQ ID NO: 2052 - RNA, 27 nt, Artificial Sequence
  Description of Artificial Sequence: Synthetic oligonucleotide
ggcucccagagucaucccugcuucaua

SEQ ID NO: 2053 - RNA, 27 nt, Artificial Sequence
  Description of Artificial Sequence: Synthetic oligonucleotide
gggcucccagagucaucccugcuucau

SEQ ID NO: 2054 - RNA, 27 nt, Artificial Sequence
  Description of Artificial Sequence: Synthetic oligonucleotide
cgggcucccagagucaucccugcuuca

SEQ ID NO: 2055 - RNA, 27 nt, Artificial Sequence
  Description of Artificial Sequence: Synthetic oligonucleotide
ccgggcucccagagucaucccugcuuc

SEQ ID NO: 2056 - RNA, 27 nt, Artificial Sequence
  Description of Artificial Sequence: Synthetic oligonucleotide
uccgggcucccagagucaucccugcuu

SEQ ID NO: 2057 - RNA, 27 nt, Artificial Sequence
  Description of Artificial Sequence: Synthetic oligonucleotide
uuccgggcucccagagucaucccugcu

SEQ ID NO: 2058 - RNA, 27 nt, Artificial Sequence
  Description of Artificial Sequence: Synthetic oligonucleotide
uaguuucagauuaccaaguuucuucag

SEQ ID NO: 2059 - RNA, 27 nt, Artificial Sequence
  Description of Artificial Sequence: Synthetic oligonucleotide
aagccucuccuuccuccuguaguuuca

SEQ ID NO: 2060 - RNA, 27 nt, Artificial Sequence
  Description of Artificial Sequence: Synthetic oligonucleotide
gaagccucuccuuccuccuguaguuuc

SEQ ID NO: 2061 - RNA, 27 nt, Artificial Sequence
  Description of Artificial Sequence: Synthetic oligonucleotide
gggcugacauucauagccuucaaugug

SEQ ID NO: 2062 - RNA, 27 nt, Artificial Sequence
  Description of Artificial Sequence: Synthetic oligonucleotide
ugggcugacauucauagccuucaaugu

SEQ ID NO: 2063 - RNA, 27 nt, Artificial Sequence
  Description of Artificial Sequence: Synthetic oligonucleotide
augggcugacauucauagccuucaaug

SEQ ID NO: 2064 - RNA, 27 nt, Artificial Sequence
  Description of Artificial Sequence: Synthetic oligonucleotide
gaugggcugacauucauagccuucaau

SEQ ID NO: 2065 - RNA, 27 nt, Artificial Sequence
  Description of Artificial Sequence: Synthetic oligonucleotide
agaugggcugacauucauagccuucaa

SEQ ID NO: 2066 - RNA, 27 nt, Artificial Sequence
  Description of Artificial Sequence: Synthetic oligonucleotide
aagaugggcugacauucauagccuuca

SEQ ID NO: 2067 - RNA, 27 nt, Artificial Sequence
  Description of Artificial Sequence: Synthetic oligonucleotide
caccuggcucaauggcuuccaggacau

SEQ ID NO: 2068 - RNA, 27 nt, Artificial Sequence
  Description of Artificial Sequence: Synthetic oligonucleotide
acaccuggcucaauggcuuccaggaca

SEQ ID NO: 2069 - RNA, 27 nt, Artificial Sequence
  Description of Artificial Sequence: Synthetic oligonucleotide
uacaccuggcucaauggcuuccaggac

SEQ ID NO: 2070 - RNA, 27 nt, Artificial Sequence
  Description of Artificial Sequence: Synthetic oligonucleotide
cuacaccuggcucaauggcuuccagga

SEQ ID NO: 2071 - RNA, 27 nt, Artificial Sequence
  Description of Artificial Sequence: Synthetic oligonucleotide
acuacaccuggcucaauggcuuccagg

SEQ ID NO: 2072 - RNA, 27 nt, Artificial Sequence
  Description of Artificial Sequence: Synthetic oligonucleotide
gcaaggcugcaaaggagucgggcuggu

SEQ ID NO: 2073 - RNA, 27 nt, Artificial Sequence
  Description of Artificial Sequence: Synthetic oligonucleotide
uagagagcaaggcugcaaaggagucgg

SEQ ID NO: 2074 - RNA, 27 nt, Artificial Sequence
  Description of Artificial Sequence: Synthetic oligonucleotide
ucauugaggcuagagagcaaggcugca

SEQ ID NO: 2075 - RNA, 27 nt, Artificial Sequence
  Description of Artificial Sequence: Synthetic oligonucleotide
gcaaggccuuggcccacuugaccacgu

SEQ ID NO: 2076 - RNA, 27 nt, Artificial Sequence
  Description of Artificial Sequence: Synthetic oligonucleotide
ggcaaggccuuggcccacuugaccacg

SEQ ID NO: 2077 - RNA, 27 nt, Artificial Sequence
  Description of Artificial Sequence: Synthetic oligonucleotide
aggcaaggccuuggcccacuugaccac

SEQ ID NO: 2078 - RNA, 27 nt, Artificial Sequence
  Description of Artificial Sequence: Synthetic oligonucleotide
caggcaaggccuuggcccacuugacca

SEQ ID NO: 2079 - RNA, 27 nt, Artificial Sequence
  Description of Artificial Sequence: Synthetic oligonucleotide
ccaggcaaggccuuggcccacuugacc

SEQ ID NO: 2080 - RNA, 27 nt, Artificial Sequence
  Description of Artificial Sequence: Synthetic oligonucleotide
gccaggcaaggccuuggcccacuugac

SEQ ID NO: 2081 - RNA, 27 nt, Artificial Sequence
  Description of Artificial Sequence: Synthetic oligonucleotide
agccaggcaaggccuuggcccacuuga

SEQ ID NO: 2082 - RNA, 27 nt, Artificial Sequence
  Description of Artificial Sequence: Synthetic oligonucleotide
aagccaggcaaggccuuggcccacuug

SEQ ID NO: 2083 - RNA, 27 nt, Artificial Sequence
  Description of Artificial Sequence: Synthetic oligonucleotide
gaagccaggcaaggccuuggcccacuu

SEQ ID NO: 2084 - RNA, 27 nt, Artificial Sequence
  Description of Artificial Sequence: Synthetic oligonucleotide
ggaagccaggcaaggccuuggcccacu

SEQ ID NO: 2085 - RNA, 27 nt, Artificial Sequence
  Description of Artificial Sequence: Synthetic oligonucleotide
cggaagccaggcaaggccuuggcccac

SEQ ID NO: 2086 - RNA, 27 nt, Artificial Sequence
  Description of Artificial Sequence: Synthetic oligonucleotide
gcggaagccaggcaaggccuuggccca

SEQ ID NO: 2087 - RNA, 27 nt, Artificial Sequence
  Description of Artificial Sequence: Synthetic oligonucleotide
ugcggaagccaggcaaggccuuggccc

SEQ ID NO: 2088 - RNA, 27 nt, Artificial Sequence
  Description of Artificial Sequence: Synthetic oligonucleotide
uugcggaagccaggcaaggccuuggcc

SEQ ID NO: 2089 - RNA, 27 nt, Artificial Sequence
  Description of Artificial Sequence: Synthetic oligonucleotide
guugcggaagccaggcaaggccuuggc

SEQ ID NO: 2090 - RNA, 27 nt, Artificial Sequence
  Description of Artificial Sequence: Synthetic oligonucleotide
aguugcggaagccaggcaaggccuugg

SEQ ID NO: 2091 - RNA, 27 nt, Artificial Sequence
  Description of Artificial Sequence: Synthetic oligonucleotide
aaguugcggaagccaggcaaggccuug

SEQ ID NO: 2092 - RNA, 27 nt, Artificial Sequence
  Description of Artificial Sequence: Synthetic oligonucleotide
uaaguugcggaagccaggcaaggccuu

SEQ ID NO: 2093 - RNA, 27 nt, Artificial Sequence
  Description of Artificial Sequence: Synthetic oligonucleotide
guaaguugcggaagccaggcaaggccu

SEQ ID NO: 2094 - RNA, 27 nt, Artificial Sequence
  Description of Artificial Sequence: Synthetic oligonucleotide
uguaaguugcggaagccaggcaaggcc

SEQ ID NO: 2095 - RNA, 27 nt, Artificial Sequence
  Description of Artificial Sequence: Synthetic oligonucleotide
guguaaguugcggaagccaggcaaggc

SEQ ID NO: 2096 - RNA, 27 nt, Artificial Sequence
  Description of Artificial Sequence: Synthetic oligonucleotide
cguguaaguugcggaagccaggcaagg

SEQ ID NO: 2097 - RNA, 27 nt, Artificial Sequence
  Description of Artificial Sequence: Synthetic oligonucleotide
acguguaaguugcggaagccaggcaag

SEQ ID NO: 2098 - RNA, 27 nt, Artificial Sequence
  Description of Artificial Sequence: Synthetic oligonucleotide
aguagagcauccuggaguugacauugg

SEQ ID NO: 2099 - RNA, 27 nt, Artificial Sequence
  Description of Artificial Sequence: Synthetic oligonucleotide
aaguagagcauccuggaguugacauug

SEQ ID NO: 2100 - RNA, 27 nt, Artificial Sequence
  Description of Artificial Sequence: Synthetic oligonucleotide
gaaguagagcauccuggaguugacauu

SEQ ID NO: 2101 - RNA, 27 nt, Artificial Sequence
  Description of Artificial Sequence: Synthetic oligonucleotide
cgaaguagagcauccuggaguugacau

SEQ ID NO: 2102 - RNA, 27 nt, Artificial Sequence
  Description of Artificial Sequence: Synthetic oligonucleotide
gcgaaguagagcauccuggaguugaca

SEQ ID NO: 2103 - RNA, 27 nt, Artificial Sequence
  Description of Artificial Sequence: Synthetic oligonucleotide
ggcgaaguagagcauccuggaguugac

SEQ ID NO: 2104 - RNA, 27 nt, Artificial Sequence
  Description of Artificial Sequence: Synthetic oligonucleotide
gggcgaaguagagcauccuggaguuga

SEQ ID NO: 2105 - RNA, 27 nt, Artificial Sequence
  Description of Artificial Sequence: Synthetic oligonucleotide
ugcaugcgguacucauugaaaaccaga

SEQ ID NO: 2106 - RNA, 27 nt, Artificial Sequence
  Description of Artificial Sequence: Synthetic oligonucleotide
gugcaugcgguacucauugaaaaccag

SEQ ID NO: 2107 - RNA, 27 nt, Artificial Sequence
  Description of Artificial Sequence: Synthetic oligonucleotide
ugugcaugcgguacucauugaaaacca

SEQ ID NO: 2108 - RNA, 27 nt, Artificial Sequence
  Description of Artificial Sequence: Synthetic oligonucleotide
uugugcaugcgguacucauugaaaacc

SEQ ID NO: 2109 - RNA, 27 nt, Artificial Sequence
  Description of Artificial Sequence: Synthetic oligonucleotide
cuugugcaugcgguacucauugaaaac

SEQ ID NO: 2110 - RNA, 27 nt, Artificial Sequence
  Description of Artificial Sequence: Synthetic oligonucleotide
acuugugcaugcgguacucauugaaaa

SEQ ID NO: 2111 - RNA, 27 nt, Artificial Sequence
  Description of Artificial Sequence: Synthetic oligonucleotide
gacuugugcaugcgguacucauugaaa

SEQ ID NO: 2112 - RNA, 27 nt, Artificial Sequence
  Description of Artificial Sequence: Synthetic oligonucleotide
ggacuugugcaugcgguacucauugaa

SEQ ID NO: 2113 - RNA, 27 nt, Artificial Sequence
  Description of Artificial Sequence: Synthetic oligonucleotide
gggacuugugcaugcgguacucauuga

SEQ ID NO: 2114 - RNA, 27 nt, Artificial Sequence
  Description of Artificial Sequence: Synthetic oligonucleotide
cgggacuugugcaugcgguacucauug

SEQ ID NO: 2115 - RNA, 27 nt, Artificial Sequence
  Description of Artificial Sequence: Synthetic oligonucleotide
ccgggacuugugcaugcgguacucauu

SEQ ID NO: 2116 - RNA, 27 nt, Artificial Sequence
  Description of Artificial Sequence: Synthetic oligonucleotide
uccgggacuugugcaugcgguacucau

SEQ ID NO: 2117 - RNA, 27 nt, Artificial Sequence
  Description of Artificial Sequence: Synthetic oligonucleotide
auccgggacuugugcaugcgguacuca

SEQ ID NO: 2118 - RNA, 27 nt, Artificial Sequence
  Description of Artificial Sequence: Synthetic oligonucleotide
uuuggagccauccaaacucuugagaga

SEQ ID NO: 2119 - RNA, 27 nt, Artificial Sequence
  Description of Artificial Sequence: Synthetic oligonucleotide
auuuggagccauccaaacucuugagag

SEQ ID NO: 2120 - RNA, 27 nt, Artificial Sequence
  Description of Artificial Sequence: Synthetic oligonucleotide
gauuuggagccauccaaacucuugaga

SEQ ID NO: 2121 - RNA, 27 nt, Artificial Sequence
  Description of Artificial Sequence: Synthetic oligonucleotide
ugauuuggagccauccaaacucuugag

SEQ ID NO: 2122 - RNA, 27 nt, Artificial Sequence
  Description of Artificial Sequence: Synthetic oligonucleotide
gugauuuggagccauccaaacucuuga

SEQ ID NO: 2123 - RNA, 27 nt, Artificial Sequence
  Description of Artificial Sequence: Synthetic oligonucleotide
ggugauuuggagccauccaaacucuug

SEQ ID NO: 2124 - RNA, 27 nt, Artificial Sequence
  Description of Artificial Sequence: Synthetic oligonucleotide
gggugauuuggagccauccaaacucuu

SEQ ID NO: 2125 - RNA, 27 nt, Artificial Sequence
  Description of Artificial Sequence: Synthetic oligonucleotide
gugcuuucaugcacaggaauuccuggg

SEQ ID NO: 2126 - RNA, 27 nt, Artificial Sequence
  Description of Artificial Sequence: Synthetic oligonucleotide
agugcuuucaugcacaggaauuccugg

SEQ ID NO: 2127 - RNA, 27 nt, Artificial Sequence
  Description of Artificial Sequence: Synthetic oligonucleotide
cagugcuuucaugcacaggaauuccug

SEQ ID NO: 2128 - RNA, 27 nt, Artificial Sequence
  Description of Artificial Sequence: Synthetic oligonucleotide
gcagugcuuucaugcacaggaauuccu

SEQ ID NO: 2129 - RNA, 27 nt, Artificial Sequence
  Description of Artificial Sequence: Synthetic oligonucleotide
agcagugcuuucaugcacaggaauucc

SEQ ID NO: 2130 - RNA, 27 nt, Artificial Sequence
  Description of Artificial Sequence: Synthetic oligonucleotide
uagcagugcuuucaugcacaggaauuc

SEQ ID NO: 2131 - RNA, 27 nt, Artificial Sequence
  Description of Artificial Sequence: Synthetic oligonucleotide
guagcagugcuuucaugcacaggaauu

SEQ ID NO: 2132 - RNA, 27 nt, Artificial Sequence
  Description of Artificial Sequence: Synthetic oligonucleotide
aguagcagugcuuucaugcacaggaau

SEQ ID NO: 2133 - RNA, 27 nt, Artificial Sequence
  Description of Artificial Sequence: Synthetic oligonucleotide
gaguagcagugcuuucaugcacaggaa

SEQ ID NO: 2134 - RNA, 27 nt, Artificial Sequence
  Description of Artificial Sequence: Synthetic oligonucleotide
agaguagcagugcuuucaugcacagga

SEQ ID NO: 2135 - RNA, 27 nt, Artificial Sequence
  Description of Artificial Sequence: Synthetic oligonucleotide
aagaguagcagugcuuucaugcacagg

SEQ ID NO: 2136 - RNA, 27 nt, Artificial Sequence
  Description of Artificial Sequence: Synthetic oligonucleotide
cauccacuggaauaaugcugaagagua

SEQ ID NO: 2137 - RNA, 27 nt, Artificial Sequence
  Description of Artificial Sequence: Synthetic oligonucleotide
ccauccacuggaauaaugcugaagagu

SEQ ID NO: 2138 - RNA, 27 nt, Artificial Sequence
  Description of Artificial Sequence: Synthetic oligonucleotide
cccauccacuggaauaaugcugaagag

SEQ ID NO: 2139 - RNA, 27 nt, Artificial Sequence
  Description of Artificial Sequence: Synthetic oligonucleotide
gcccauccacuggaauaaugcugaaga

SEQ ID NO: 2140 - RNA, 27 nt, Artificial Sequence
  Description of Artificial Sequence: Synthetic oligonucleotide
agcccauccacuggaauaaugcugaag

SEQ ID NO: 2141 - RNA, 27 nt, Artificial Sequence
  Description of Artificial Sequence: Synthetic oligonucleotide
cagcccauccacuggaauaaugcugaa

SEQ ID NO: 2142 - RNA, 27 nt, Artificial Sequence
  Description of Artificial Sequence: Synthetic oligonucleotide
ucagcccauccacuggaauaaugcuga

SEQ ID NO: 2143 - RNA, 27 nt, Artificial Sequence
  Description of Artificial Sequence: Synthetic oligonucleotide
uucagcccauccacuggaauaaugcug

SEQ ID NO: 2144 - RNA, 27 nt, Artificial Sequence
  Description of Artificial Sequence: Synthetic oligonucleotide
uuucagcccauccacuggaauaaugcu

SEQ ID NO: 2145 - RNA, 27 nt, Artificial Sequence
  Description of Artificial Sequence: Synthetic oligonucleotide
uuuucagcccauccacuggaauaaugc

SEQ ID NO: 2146 - RNA, 27 nt, Artificial Sequence
  Description of Artificial Sequence: Synthetic oligonucleotide
uuuuucagcccauccacuggaauaaug

SEQ ID NO: 2147 - RNA, 27 nt, Artificial Sequence
  Description of Artificial Sequence: Synthetic oligonucleotide
auuuuucagcccauccacuggaauaau

SEQ ID NO: 2148 - RNA, 27 nt, Artificial Sequence
  Description of Artificial Sequence: Synthetic oligonucleotide
gauuuuucagcccauccacuggaauaa

SEQ ID NO: 2149 - RNA, 27 nt, Artificial Sequence
  Description of Artificial Sequence: Synthetic oligonucleotide
ugauuuuucagcccauccacuggaaua

SEQ ID NO: 2150 - RNA, 27 nt, Artificial Sequence
  Description of Artificial Sequence: Synthetic oligonucleotide
uugauuuuucagcccauccacuggaau

SEQ ID NO: 2151 - RNA, 27 nt, Artificial Sequence
  Description of Artificial Sequence: Synthetic oligonucleotide
uuugauuuuucagcccauccacuggaa

SEQ ID NO: 2152 - RNA, 27 nt, Artificial Sequence
  Description of Artificial Sequence: Synthetic oligonucleotide
uuuugauuuuucagcccauccacugga

SEQ ID NO: 2153 - RNA, 27 nt, Artificial Sequence
  Description of Artificial Sequence: Synthetic oligonucleotide
uuuuugauuuuucagcccauccacugg

SEQ ID NO: 2154 - RNA, 27 nt, Artificial Sequence
  Description of Artificial Sequence: Synthetic oligonucleotide
auuuuugauuuuucagcccauccacug

SEQ ID NO: 2155 - RNA, 27 nt, Artificial Sequence
  Description of Artificial Sequence: Synthetic oligonucleotide
aauuuuugauuuuucagcccauccacu

SEQ ID NO: 2156 - RNA, 27 nt, Artificial Sequence
  Description of Artificial Sequence: Synthetic oligonucleotide
gaauuuuugauuuuucagcccauccac

SEQ ID NO: 2157 - RNA, 27 nt, Artificial Sequence
  Description of Artificial Sequence: Synthetic oligonucleotide
agaauuuuugauuuuucagcccaucca

SEQ ID NO: 2158 - RNA, 27 nt, Artificial Sequence
  Description of Artificial Sequence: Synthetic oligonucleotide
aagaauuuuugauuuuucagcccaucc

SEQ ID NO: 2159 - RNA, 27 nt, Artificial Sequence
  Description of Artificial Sequence: Synthetic oligonucleotide
aaagaauuuuugauuuuucagcccauc

SEQ ID NO: 2160 - RNA, 27 nt, Artificial Sequence
  Description of Artificial Sequence: Synthetic oligonucleotide
caaagaauuuuugauuuuucagcccau

SEQ ID NO: 2161 - RNA, 27 nt, Artificial Sequence
  Description of Artificial Sequence: Synthetic oligonucleotide
ucaaagaauuuuugauuuuucagccca

SEQ ID NO: 2162 - RNA, 27 nt, Artificial Sequence
  Description of Artificial Sequence: Synthetic oligonucleotide
aucaaagaauuuuugauuuuucagccc

SEQ ID NO: 2163 - RNA, 27 nt, Artificial Sequence
  Description of Artificial Sequence: Synthetic oligonucleotide
caucaaagaauuuuugauuuuucagcc

SEQ ID NO: 2164 - RNA, 27 nt, Artificial Sequence
  Description of Artificial Sequence: Synthetic oligonucleotide
ucaucaaagaauuuuugauuuuucagc

SEQ ID NO: 2165 - RNA, 27 nt, Artificial Sequence
  Description of Artificial Sequence: Synthetic oligonucleotide
uucaucaaagaauuuuugauuuuucag

SEQ ID NO: 2166 - RNA, 27 nt, Artificial Sequence
  Description of Artificial Sequence: Synthetic oligonucleotide
guucaucaaagaauuuuugauuuuuca

SEQ ID NO: 2167 - RNA, 27 nt, Artificial Sequence
  Description of Artificial Sequence: Synthetic oligonucleotide
aaguucaucaaagaauuuuugauuuuu

SEQ ID NO: 2168 - RNA, 27 nt, Artificial Sequence
  Description of Artificial Sequence: Synthetic oligonucleotide
gaaguucaucaaagaauuuuugauuuu

SEQ ID NO: 2169 - RNA, 27 nt, Artificial Sequence
  Description of Artificial Sequence: Synthetic oligonucleotide
cgaaguucaucaaagaauuuuugauuu

SEQ ID NO: 2170 - RNA, 27 nt, Artificial Sequence
  Description of Artificial Sequence: Synthetic oligonucleotide
ucgaaguucaucaaagaauuuuugauu

SEQ ID NO: 2171 - RNA, 27 nt, Artificial Sequence
  Description of Artificial Sequence: Synthetic oligonucleotide
uucgaaguucaucaaagaauuuuugau

SEQ ID NO: 2172 - RNA, 27 nt, Artificial Sequence
  Description of Artificial Sequence: Synthetic oligonucleotide
auucgaaguucaucaaagaauuuuuga

SEQ ID NO: 2173 - RNA, 27 nt, Artificial Sequence
  Description of Artificial Sequence: Synthetic oligonucleotide
cauucgaaguucaucaaagaauuuuug

SEQ ID NO: 2174 - RNA, 27 nt, Artificial Sequence
  Description of Artificial Sequence: Synthetic oligonucleotide
ucauucgaaguucaucaaagaauuuuu

SEQ ID NO: 2175 - RNA, 27 nt, Artificial Sequence
  Description of Artificial Sequence: Synthetic oligonucleotide
uucauucgaaguucaucaaagaauuuu

SEQ ID NO: 2176 - RNA, 27 nt, Artificial Sequence
  Description of Artificial Sequence: Synthetic oligonucleotide
guucauucgaaguucaucaaagaauuu

SEQ ID NO: 2177 - RNA, 27 nt, Artificial Sequence
  Description of Artificial Sequence: Synthetic oligonucleotide
aguucauucgaaguucaucaaagaauu

SEQ ID NO: 2178 - RNA, 27 nt, Artificial Sequence
  Description of Artificial Sequence: Synthetic oligonucleotide
uaguucauucgaaguucaucaaagaau

SEQ ID NO: 2179 - RNA, 27 nt, Artificial Sequence
  Description of Artificial Sequence: Synthetic oligonucleotide
guaguucauucgaaguucaucaaagaa

SEQ ID NO: 2180 - RNA, 27 nt, Artificial Sequence
  Description of Artificial Sequence: Synthetic oligonucleotide
uguaguucauucgaaguucaucaaaga

SEQ ID NO: 2181 - RNA, 27 nt, Artificial Sequence
  Description of Artificial Sequence: Synthetic oligonucleotide
auguaguucauucgaaguucaucaaag

SEQ ID NO: 2182 - RNA, 27 nt, Artificial Sequence
  Description of Artificial Sequence: Synthetic oligonucleotide
gauguaguucauucgaaguucaucaaa

SEQ ID NO: 2183 - RNA, 27 nt, Artificial Sequence
  Description of Artificial Sequence: Synthetic oligonucleotide
ugauguaguucauucgaaguucaucaa

SEQ ID NO: 2184 - RNA, 27 nt, Artificial Sequence
  Description of Artificial Sequence: Synthetic oligonucleotide
uugauguaguucauucgaaguucauca

SEQ ID NO: 2185 - RNA, 27 nt, Artificial Sequence
  Description of Artificial Sequence: Synthetic oligonucleotide
cuugauguaguucauucgaaguucauc

SEQ ID NO: 2186 - RNA, 27 nt, Artificial Sequence
  Description of Artificial Sequence: Synthetic oligonucleotide
ccuugauguaguucauucgaaguucau

SEQ ID NO: 2187 - RNA, 27 nt, Artificial Sequence
  Description of Artificial Sequence: Synthetic oligonucleotide
uccuugauguaguucauucgaaguuca

SEQ ID NO: 2188 - RNA, 27 nt, Artificial Sequence
  Description of Artificial Sequence: Synthetic oligonucleotide
uuccuugauguaguucauucgaaguuc

SEQ ID NO: 2189 - RNA, 27 nt, Artificial Sequence
  Description of Artificial Sequence: Synthetic oligonucleotide
guuccuugauguaguucauucgaaguu

SEQ ID NO: 2190 - RNA, 27 nt, Artificial Sequence
  Description of Artificial Sequence: Synthetic oligonucleotide
aguuccuugauguaguucauucgaagu

SEQ ID NO: 2191 - RNA, 27 nt, Artificial Sequence
  Description of Artificial Sequence: Synthetic oligonucleotide
gaguuccuugauguaguucauucgaag

SEQ ID NO: 2192 - RNA, 27 nt, Artificial Sequence
  Description of Artificial Sequence: Synthetic oligonucleotide
cgaguuccuugauguaguucauucgaa

SEQ ID NO: 2193 - RNA, 27 nt, Artificial Sequence
  Description of Artificial Sequence: Synthetic oligonucleotide
ucgaguuccuugauguaguucauucga

SEQ ID NO: 2194 - RNA, 27 nt, Artificial Sequence
  Description of Artificial Sequence: Synthetic oligonucleotide
aucgaguuccuugauguaguucauucg

SEQ ID NO: 2195 - RNA, 27 nt, Artificial Sequence
  Description of Artificial Sequence: Synthetic oligonucleotide
gaucgaguuccuugauguaguucauuc

SEQ ID NO: 2196 - RNA, 27 nt, Artificial Sequence
  Description of Artificial Sequence: Synthetic oligonucleotide
cgaucgaguuccuugauguaguucauu

SEQ ID NO: 2197 - RNA, 27 nt, Artificial Sequence
  Description of Artificial Sequence: Synthetic oligonucleotide
acgaucgaguuccuugauguaguucau

SEQ ID NO: 2198 - RNA, 27 nt, Artificial Sequence
  Description of Artificial Sequence: Synthetic oligonucleotide
uacgaucgaguuccuugauguaguuca

SEQ ID NO: 2199 - RNA, 27 nt, Artificial Sequence
  Description of Artificial Sequence: Synthetic oligonucleotide
auacgaucgaguuccuugauguaguuc

SEQ ID NO: 2200 - RNA, 27 nt, Artificial Sequence
  Description of Artificial Sequence: Synthetic oligonucleotide
gauacgaucgaguuccuugauguaguu

SEQ ID NO: 2201 - RNA, 27 nt, Artificial Sequence
  Description of Artificial Sequence: Synthetic oligonucleotide
ugauacgaucgaguuccuugauguagu

SEQ ID NO: 2202 - RNA, 27 nt, Artificial Sequence
  Description of Artificial Sequence: Synthetic oligonucleotide
augauacgaucgaguuccuugauguag

SEQ ID NO: 2203 - RNA, 27 nt, Artificial Sequence
  Description of Artificial Sequence: Synthetic oligonucleotide
gauuuuuucuuuugcaugcaaugauac

SEQ ID NO: 2204 - RNA, 27 nt, Artificial Sequence
  Description of Artificial Sequence: Synthetic oligonucleotide
ggauuuuuucuuuugcaugcaaugaua

SEQ ID NO: 2205 - RNA, 27 nt, Artificial Sequence
  Description of Artificial Sequence: Synthetic oligonucleotide
agcgucuugagcaggaugugggauuuu

SEQ ID NO: 2206 - RNA, 27 nt, Artificial Sequence
  Description of Artificial Sequence: Synthetic oligonucleotide
aagcgucuugagcaggaugugggauuu

SEQ ID NO: 2207 - RNA, 27 nt, Artificial Sequence
  Description of Artificial Sequence: Synthetic oligonucleotide
ggagcuuggugagcugguagaagcguc

SEQ ID NO: 2208 - RNA, 27 nt, Artificial Sequence
  Description of Artificial Sequence: Synthetic oligonucleotide
aggagcuuggugagcugguagaagcgu

SEQ ID NO: 2209 - RNA, 27 nt, Artificial Sequence
  Description of Artificial Sequence: Synthetic oligonucleotide
caggagcuuggugagcugguagaagcg

SEQ ID NO: 2210 - RNA, 27 nt, Artificial Sequence
  Description of Artificial Sequence: Synthetic oligonucleotide
ccaggagcuuggugagcugguagaagc

SEQ ID NO: 2211 - RNA, 27 nt, Artificial Sequence
  Description of Artificial Sequence: Synthetic oligonucleotide
uccaggagcuuggugagcugguagaag

SEQ ID NO: 2212 - RNA, 27 nt, Artificial Sequence
  Description of Artificial Sequence: Synthetic oligonucleotide
guccaggagcuuggugagcugguagaa

SEQ ID NO: 2213 - RNA, 27 nt, Artificial Sequence
  Description of Artificial Sequence: Synthetic oligonucleotide
aguccaggagcuuggugagcugguaga

SEQ ID NO: 2214 - RNA, 27 nt, Artificial Sequence
  Description of Artificial Sequence: Synthetic oligonucleotide
gaguccaggagcuuggugagcugguag

SEQ ID NO: 2215 - RNA, 27 nt, Artificial Sequence
  Description of Artificial Sequence: Synthetic oligonucleotide
ggaguccaggagcuuggugagcuggua

SEQ ID NO: 2216 - RNA, 27 nt, Artificial Sequence
  Description of Artificial Sequence: Synthetic oligonucleotide
cggaguccaggagcuuggugagcuggu

SEQ ID NO: 2217 - RNA, 27 nt, Artificial Sequence
  Description of Artificial Sequence: Synthetic oligonucleotide
acggaguccaggagcuuggugagcugg

SEQ ID NO: 2218 - RNA, 27 nt, Artificial Sequence
  Description of Artificial Sequence: Synthetic oligonucleotide
gcacggaguccaggagcuuggugagcu

SEQ ID NO: 2219 - RNA, 27 nt, Artificial Sequence
  Description of Artificial Sequence: Synthetic oligonucleotide
caauaggcugcacggaguccaggagcu

SEQ ID NO: 2220 - RNA, 27 nt, Artificial Sequence
  Description of Artificial Sequence: Synthetic oligonucleotide
cagcucucucgcaauaggcugcacgga

SEQ ID NO: 2221 - RNA, 27 nt, Artificial Sequence
  Description of Artificial Sequence: Synthetic oligonucleotide
caaaagugaacugaugcagcucucucg

SEQ ID NO: 2222 - RNA, 27 nt, Artificial Sequence
  Description of Artificial Sequence: Synthetic oligonucleotide
ucaaaagugaacugaugcagcucucuc

SEQ ID NO: 2223 - RNA, 27 nt, Artificial Sequence
  Description of Artificial Sequence: Synthetic oligonucleotide
gucaaaagugaacugaugcagcucucu

SEQ ID NO: 2224 - RNA, 27 nt, Artificial Sequence
  Description of Artificial Sequence: Synthetic oligonucleotide
ggucaaaagugaacugaugcagcucuc

SEQ ID NO: 2225 - RNA, 27 nt, Artificial Sequence
  Description of Artificial Sequence: Synthetic oligonucleotide
aggucaaaagugaacugaugcagcucu

SEQ ID NO: 2226 - RNA, 27 nt, Artificial Sequence
  Description of Artificial Sequence: Synthetic oligonucleotide
caggucaaaagugaacugaugcagcuc

SEQ ID NO: 2227 - RNA, 27 nt, Artificial Sequence
  Description of Artificial Sequence: Synthetic oligonucleotide
gcaggucaaaagugaacugaugcagcu

SEQ ID NO: 2228 - RNA, 27 nt, Artificial Sequence
  Description of Artificial Sequence: Synthetic oligonucleotide
agcaggucaaaagugaacugaugcagc

SEQ ID NO: 2229 - RNA, 27 nt, Artificial Sequence
  Description of Artificial Sequence: Synthetic oligonucleotide
uagcaggucaaaagugaacugaugcag

SEQ ID NO: 2230 - RNA, 27 nt, Artificial Sequence
  Description of Artificial Sequence: Synthetic oligonucleotide
uuagcaggucaaaagugaacugaugca

SEQ ID NO: 2231 - RNA, 27 nt, Artificial Sequence
  Description of Artificial Sequence: Synthetic oligonucleotide
auuagcaggucaaaagugaacugaugc

SEQ ID NO: 2232 - RNA, 27 nt, Artificial Sequence
  Description of Artificial Sequence: Synthetic oligonucleotide
gauuagcaggucaaaagugaacugaug

SEQ ID NO: 2233 - RNA, 27 nt, Artificial Sequence
  Description of Artificial Sequence: Synthetic oligonucleotide
ugauuagcaggucaaaagugaacugau

SEQ ID NO: 2234 - RNA, 27 nt, Artificial Sequence
  Description of Artificial Sequence: Synthetic oligonucleotide
uugauuagcaggucaaaagugaacuga

SEQ ID NO: 2235 - RNA, 27 nt, Artificial Sequence
  Description of Artificial Sequence: Synthetic oligonucleotide
cuugauuagcaggucaaaagugaacug

SEQ ID NO: 2236 - RNA, 27 nt, Artificial Sequence
  Description of Artificial Sequence: Synthetic oligonucleotide
acuugauuagcaggucaaaagugaacu

SEQ ID NO: 2237 - RNA, 27 nt, Artificial Sequence
  Description of Artificial Sequence: Synthetic oligonucleotide
gacuugauuagcaggucaaaagugaac

SEQ ID NO: 2238 - RNA, 27 nt, Artificial Sequence
  Description of Artificial Sequence: Synthetic oligonucleotide
ugacuugauuagcaggucaaaagugaa

SEQ ID NO: 2239 - RNA, 27 nt, Artificial Sequence
  Description of Artificial Sequence: Synthetic oligonucleotide
gugacuugauuagcaggucaaaaguga

SEQ ID NO: 2240 - RNA, 27 nt, Artificial Sequence
  Description of Artificial Sequence: Synthetic oligonucleotide
ugugacuugauuagcaggucaaaagug

SEQ ID NO: 2241 - RNA, 27 nt, Artificial Sequence
  Description of Artificial Sequence: Synthetic oligonucleotide
gugugacuugauuagcaggucaaaagu

SEQ ID NO: 2242 - RNA, 27 nt, Artificial Sequence
  Description of Artificial Sequence: Synthetic oligonucleotide
uuuccggaaaguccacgcucaccaugu

SEQ ID NO: 2243 - RNA, 27 nt, Artificial Sequence
  Description of Artificial Sequence: Synthetic oligonucleotide
auuuccggaaaguccacgcucaccaug

SEQ ID NO: 2244 - RNA, 27 nt, Artificial Sequence
  Description of Artificial Sequence: Synthetic oligonucleotide
cagagaugaucucugccaucauuuccg

SEQ ID NO: 2245 - RNA, 27 nt, Artificial Sequence
  Description of Artificial Sequence: Synthetic oligonucleotide
acagagaugaucucugccaucauuucc

SEQ ID NO: 2246 - RNA, 27 nt, Artificial Sequence
  Description of Artificial Sequence: Synthetic oligonucleotide
cacagagaugaucucugccaucauuuc

SEQ ID NO: 2247 - RNA, 27 nt, Artificial Sequence
  Description of Artificial Sequence: Synthetic oligonucleotide
gcacagagaugaucucugccaucauuu

SEQ ID NO: 2248 - RNA, 27 nt, Artificial Sequence
  Description of Artificial Sequence: Synthetic oligonucleotide
ugcacagagaugaucucugccaucauu

SEQ ID NO: 2249 - RNA, 27 nt, Artificial Sequence
  Description of Artificial Sequence: Synthetic oligonucleotide
uugcacagagaugaucucugccaucau

SEQ ID NO: 2250 - RNA, 27 nt, Artificial Sequence
  Description of Artificial Sequence: Synthetic oligonucleotide
cuugcacagagaugaucucugccauca

SEQ ID NO: 2251 - RNA, 27 nt, Artificial Sequence
  Description of Artificial Sequence: Synthetic oligonucleotide
acuugcacagagaugaucucugccauc

SEQ ID NO: 2252 - RNA, 27 nt, Artificial Sequence
  Description of Artificial Sequence: Synthetic oligonucleotide
cacuugcacagagaugaucucugccau

SEQ ID NO: 2253 - RNA, 27 nt, Artificial Sequence
  Description of Artificial Sequence: Synthetic oligonucleotide
gcacuugcacagagaugaucucugcca

SEQ ID NO: 2254 - RNA, 27 nt, Artificial Sequence
  Description of Artificial Sequence: Synthetic oligonucleotide
ggcacuugcacagagaugaucucugcc

SEQ ID NO: 2255 - RNA, 27 nt, Artificial Sequence
  Description of Artificial Sequence: Synthetic oligonucleotide
gggcacuugcacagagaugaucucugc

SEQ ID NO: 2256 - RNA, 27 nt, Artificial Sequence
  Description of Artificial Sequence: Synthetic oligonucleotide
ugggcacuugcacagagaugaucucug

SEQ ID NO: 2257 - RNA, 27 nt, Artificial Sequence
  Description of Artificial Sequence: Synthetic oligonucleotide
uugggcacuugcacagagaugaucucu

SEQ ID NO: 2258 - RNA, 27 nt, Artificial Sequence
  Description of Artificial Sequence: Synthetic oligonucleotide
cuugggcacuugcacagagaugaucuc

SEQ ID NO: 2259 - RNA, 27 nt, Artificial Sequence
  Description of Artificial Sequence: Synthetic oligonucleotide
ucuugggcacuugcacagagaugaucu

SEQ ID NO: 2260 - RNA, 27 nt, Artificial Sequence
  Description of Artificial Sequence: Synthetic oligonucleotide
aucuugggcacuugcacagagaugauc

SEQ ID NO: 2261 - RNA, 27 nt, Artificial Sequence
  Description of Artificial Sequence: Synthetic oligonucleotide
gaucuugggcacuugcacagagaugau

SEQ ID NO: 2262 - RNA, 27 nt, Artificial Sequence
  Description of Artificial Sequence: Synthetic oligonucleotide
ggaucuugggcacuugcacagagauga

SEQ ID NO: 2263 - RNA, 27 nt, Artificial Sequence
  Description of Artificial Sequence: Synthetic oligonucleotide
aggaucuugggcacuugcacagagaug

SEQ ID NO: 2264 - RNA, 27 nt, Artificial Sequence
  Description of Artificial Sequence: Synthetic oligonucleotide
aaggaucuugggcacuugcacagagau

SEQ ID NO: 2265 - RNA, 27 nt, Artificial Sequence
  Description of Artificial Sequence: Synthetic oligonucleotide
aaaggaucuugggcacuugcacagaga

SEQ ID NO: 2266 - RNA, 27 nt, Artificial Sequence
  Description of Artificial Sequence: Synthetic oligonucleotide
gaaaggaucuugggcacuugcacagag

SEQ ID NO: 2267 - RNA, 27 nt, Artificial Sequence
  Description of Artificial Sequence: Synthetic oligonucleotide
agaaaggaucuugggcacuugcacaga

SEQ ID NO: 2268 - RNA, 27 nt, Artificial Sequence
  Description of Artificial Sequence: Synthetic oligonucleotide
cagaaaggaucuugggcacuugcacag

SEQ ID NO: 2269 - RNA, 27 nt, Artificial Sequence
  Description of Artificial Sequence: Synthetic oligonucleotide
ccagaaaggaucuugggcacuugcaca

SEQ ID NO: 2270 - RNA, 27 nt, Artificial Sequence
  Description of Artificial Sequence: Synthetic oligonucleotide
cccagaaaggaucuugggcacuugcac

SEQ ID NO: 2271 - RNA, 27 nt, Artificial Sequence
  Description of Artificial Sequence: Synthetic oligonucleotide
ucccagaaaggaucuugggcacuugca

SEQ ID NO: 2272 - RNA, 27 nt, Artificial Sequence
  Description of Artificial Sequence: Synthetic oligonucleotide
uucccagaaaggaucuugggcacuugc

SEQ ID NO: 2273 - RNA, 27 nt, Artificial Sequence
  Description of Artificial Sequence: Synthetic oligonucleotide
uuucccagaaaggaucuugggcacuug

SEQ ID NO: 2274 - RNA, 27 nt, Artificial Sequence
  Description of Artificial Sequence: Synthetic oligonucleotide
cuuucccagaaaggaucuugggcacuu

SEQ ID NO: 2275 - RNA, 27 nt, Artificial Sequence
  Description of Artificial Sequence: Synthetic oligonucleotide
acuuucccagaaaggaucuugggcacu

SEQ ID NO: 2276 - RNA, 27 nt, Artificial Sequence
  Description of Artificial Sequence: Synthetic oligonucleotide
gacuuucccagaaaggaucuugggcac

SEQ ID NO: 2277 - RNA, 27 nt, Artificial Sequence
  Description of Artificial Sequence: Synthetic oligonucleotide
ugacuuucccagaaaggaucuugggca

SEQ ID NO: 2278 - RNA, 27 nt, Artificial Sequence
  Description of Artificial Sequence: Synthetic oligonucleotide
uugacuuucccagaaaggaucuugggc

SEQ ID NO: 2279 - RNA, 27 nt, Artificial Sequence
  Description of Artificial Sequence: Synthetic oligonucleotide
cuugacuuucccagaaaggaucuuggg

SEQ ID NO: 2280 - RNA, 27 nt, Artificial Sequence
  Description of Artificial Sequence: Synthetic oligonucleotide
gcuugacuuucccagaaaggaucuugg

SEQ ID NO: 2281 - RNA, 27 nt, Artificial Sequence
  Description of Artificial Sequence: Synthetic oligonucleotide
ggcuugacuuucccagaaaggaucuug

SEQ ID NO: 2282 - RNA, 27 nt, Artificial Sequence
  Description of Artificial Sequence: Synthetic oligonucleotide
gggcuugacuuucccagaaaggaucuu

SEQ ID NO: 2283 - RNA, 27 nt, Artificial Sequence
  Description of Artificial Sequence: Synthetic oligonucleotide
ugggcuugacuuucccagaaaggaucu

SEQ ID NO: 2284 - RNA, 27 nt, Artificial Sequence
  Description of Artificial Sequence: Synthetic oligonucleotide
augggcuugacuuucccagaaaggauc

SEQ ID NO: 2285 - RNA, 27 nt, Artificial Sequence
  Description of Artificial Sequence: Synthetic oligonucleotide
gaugggcuugacuuucccagaaaggau

SEQ ID NO: 2286 - RNA, 27 nt, Artificial Sequence
  Description of Artificial Sequence: Synthetic oligonucleotide
agaugggcuugacuuucccagaaagga

SEQ ID NO: 2287 - RNA, 27 nt, Artificial Sequence
  Description of Artificial Sequence: Synthetic oligonucleotide
uagaugggcuugacuuucccagaaagg

SEQ ID NO: 2288 - RNA, 27 nt, Artificial Sequence
  Description of Artificial Sequence: Synthetic oligonucleotide
auagaugggcuugacuuucccagaaag

SEQ ID NO: 2289 - RNA, 27 nt, Artificial Sequence
  Description of Artificial Sequence: Synthetic oligonucleotide
aauagaugggcuugacuuucccagaaa

SEQ ID NO: 2290 - RNA, 27 nt, Artificial Sequence
  Description of Artificial Sequence: Synthetic oligonucleotide
aaauagaugggcuugacuuucccagaa

SEQ ID NO: 2291 - RNA, 27 nt, Artificial Sequence
  Description of Artificial Sequence: Synthetic oligonucleotide
gaaauagaugggcuugacuuucccaga

SEQ ID NO: 2292 - RNA, 27 nt, Artificial Sequence
  Description of Artificial Sequence: Synthetic oligonucleotide
ggaaauagaugggcuugacuuucccag

SEQ ID NO: 2293 - RNA, 27 nt, Artificial Sequence
  Description of Artificial Sequence: Synthetic oligonucleotide
uggaaauagaugggcuugacuuuccca

SEQ ID NO: 2294 - RNA, 27 nt, Artificial Sequence
  Description of Artificial Sequence: Synthetic oligonucleotide
guggaaauagaugggcuugacuuuccc

SEQ ID NO: 2295 - RNA, 27 nt, Artificial Sequence
  Description of Artificial Sequence: Synthetic oligonucleotide
uguggaaauagaugggcuugacuuucc

SEQ ID NO: 2296 - RNA, 27 nt, Artificial Sequence
  Description of Artificial Sequence: Synthetic oligonucleotide
guguggaaauagaugggcuugacuuuc

SEQ ID NO: 2297 - RNA, 27 nt, Artificial Sequence
  Description of Artificial Sequence: Synthetic oligonucleotide
aguuauaacaggcagaagacaucugaa

SEQ ID NO: 2298 - RNA, 27 nt, Artificial Sequence
  Description of Artificial Sequence: Synthetic oligonucleotide
gaguuauaacaggcagaagacaucuga

SEQ ID NO: 2299 - RNA, 27 nt, Artificial Sequence
  Description of Artificial Sequence: Synthetic oligonucleotide
agaguuauaacaggcagaagacaucug

SEQ ID NO: 2300 - RNA, 27 nt, Artificial Sequence
  Description of Artificial Sequence: Synthetic oligonucleotide
cagaguuauaacaggcagaagacaucu

SEQ ID NO: 2301 - RNA, 27 nt, Artificial Sequence
  Description of Artificial Sequence: Synthetic oligonucleotide
acuguacaucaauagaggaaauucccc

SEQ ID NO: 2302 - RNA, 27 nt, Artificial Sequence
  Description of Artificial Sequence: Synthetic oligonucleotide
gagaaagagaaaaaaaaagcccagcaa

SEQ ID NO: 2303 - RNA, 27 nt, Artificial Sequence
  Description of Artificial Sequence: Synthetic oligonucleotide
agagaaagagaaaaaaaaagcccagca

SEQ ID NO: 2304 - RNA, 27 nt, Artificial Sequence
  Description of Artificial Sequence: Synthetic oligonucleotide
gaaaggagagaaagagaaaaaaaaagc

SEQ ID NO: 2305 - RNA, 27 nt, Artificial Sequence
  Description of Artificial Sequence: Synthetic oligonucleotide
aaaaagaaaggagagaaagagaaaaaa

SEQ ID NO: 2306 - RNA, 27 nt, Artificial Sequence
  Description of Artificial Sequence: Synthetic oligonucleotide
uuagauagggagggaagaagaaaaaga

SEQ ID NO: 2307 - RNA, 27 nt, Artificial Sequence
  Description of Artificial Sequence: Synthetic oligonucleotide
ucaucacagauuuaaaggcauacaaca

SEQ ID NO: 2308 - RNA, 27 nt, Artificial Sequence
  Description of Artificial Sequence: Synthetic oligonucleotide
cacagaguagugcuguaaacaagcaca

SEQ ID NO: 2309 - RNA, 27 nt, Artificial Sequence
  Description of Artificial Sequence: Synthetic oligonucleotide
uuuccccagauaaucuuagcucucuaa

SEQ ID NO: 2310 - RNA, 27 nt, Artificial Sequence
  Description of Artificial Sequence: Synthetic oligonucleotide
uuugcuuguuuuuguuuugauuucccc

SEQ ID NO: 2311 - DNA, 27 bp, Artificial Sequence
  Description of Artificial Sequence: Synthetic oligonucleotide
gagccagcttgctgggagagcgggacg

SEQ ID NO: 2312 - DNA, 27 bp, Artificial Sequence
  Description of Artificial Sequence: Synthetic oligonucleotide
cggctccagcgacagccaacgcctctt

SEQ ID NO: 2313 - DNA, 27 bp, Artificial Sequence
  Description of Artificial Sequence: Synthetic oligonucleotide
cagccaacgcctcttgcagcgcggcgg

SEQ ID NO: 2314 - DNA, 27 bp, Artificial Sequence
  Description of Artificial Sequence: Synthetic oligonucleotide
gcctcttgcagcgcggcggcttcgaag

SEQ ID NO: 2315 - DNA, 27 bp, Artificial Sequence
  Description of Artificial Sequence: Synthetic oligonucleotide
tgcagcgcggcggcttcgaagccgccg

SEQ ID NO: 2316 - DNA, 27 bp, Artificial Sequence
  Description of Artificial Sequence: Synthetic oligonucleotide
cgaagccgccgcccggagctgcccttt

SEQ ID NO: 2317 - DNA, 27 bp, Artificial Sequence
  Description of Artificial Sequence: Synthetic oligonucleotide
cgccgcccggagctgccctttcctctt

SEQ ID NO: 2318 - DNA, 27 bp, Artificial Sequence
  Description of Artificial Sequence: Synthetic oligonucleotide
tgaagtttttaaaagctgctaaagact

SEQ ID NO: 2319 - DNA, 27 bp, Artificial Sequence
  Description of Artificial Sequence: Synthetic oligonucleotide
ccgtcttctctcccgcagctgcctcag

SEQ ID NO: 2320 - DNA, 27 bp, Artificial Sequence
  Description of Artificial Sequence: Synthetic oligonucleotide
ccgcagctgcctcagtcggctactctc

SEQ ID NO: 2321 - DNA, 27 bp, Artificial Sequence
  Description of Artificial Sequence: Synthetic oligonucleotide
tttggctgcgagcgggcgagctagctg

SEQ ID NO: 2322 - DNA, 27 bp, Artificial Sequence
  Description of Artificial Sequence: Synthetic oligonucleotide
cgggcgagctagctgcacattgcaaag

SEQ ID NO: 2323 - DNA, 27 bp, Artificial Sequence
  Description of Artificial Sequence: Synthetic oligonucleotide
tctctctccacctcctcctgccttccc

SEQ ID NO: 2324 - DNA, 27 bp, Artificial Sequence
  Description of Artificial Sequence: Synthetic oligonucleotide
ccagagatcaaaagatgaaaaggcagt

SEQ ID NO: 2325 - DNA, 27 bp, Artificial Sequence
  Description of Artificial Sequence: Synthetic oligonucleotide
cagtagccaaaaaacaaaacaaacaaa

SEQ ID NO: 2326 - DNA, 27 bp, Artificial Sequence
  Description of Artificial Sequence: Synthetic oligonucleotide
ccaaaaaacaaaacaaacaaaaacaaa

SEQ ID NO: 2327 - DNA, 27 bp, Artificial Sequence
  Description of Artificial Sequence: Synthetic oligonucleotide
acaaaacaaacaaaaacaaaaaagccg

SEQ ID NO: 2328 - DNA, 27 bp, Artificial Sequence
  Description of Artificial Sequence: Synthetic oligonucleotide
acaaaaaagccgaaataaaagaaaaag

SEQ ID NO: 2329 - DNA, 27 bp, Artificial Sequence
  Description of Artificial Sequence: Synthetic oligonucleotide
gccgaaataaaagaaaaagataataac

SEQ ID NO: 2330 - DNA, 27 bp, Artificial Sequence
  Description of Artificial Sequence: Synthetic oligonucleotide
aagaaaaagataataactcagttctta

SEQ ID NO: 2331 - DNA, 27 bp, Artificial Sequence
  Description of Artificial Sequence: Synthetic oligonucleotide
aaagataataactcagttcttatttgc

SEQ ID NO: 2332 - DNA, 27 bp, Artificial Sequence
  Description of Artificial Sequence: Synthetic oligonucleotide
gataataactcagttcttatttgcacc

SEQ ID NO: 2333 - DNA, 27 bp, Artificial Sequence
  Description of Artificial Sequence: Synthetic oligonucleotide
tggaggattttgtttttttcttttaag

SEQ ID NO: 2334 - DNA, 27 bp, Artificial Sequence
  Description of Artificial Sequence: Synthetic oligonucleotide
gattttgtttttttcttttaagatctg

SEQ ID NO: 2335 - DNA, 27 bp, Artificial Sequence
  Description of Artificial Sequence: Synthetic oligonucleotide
gtttttttcttttaagatctgggcatc

SEQ ID NO: 2336 - DNA, 27 bp, Artificial Sequence
  Description of Artificial Sequence: Synthetic oligonucleotide
gggcatcttttgaatctacccttcaag

SEQ ID NO: 2337 - DNA, 27 bp, Artificial Sequence
  Description of Artificial Sequence: Synthetic oligonucleotide
cagagcgctttttgcgtggttgctccc

SEQ ID NO: 2338 - DNA, 27 bp, Artificial Sequence
  Description of Artificial Sequence: Synthetic oligonucleotide
cgctttttgcgtggttgctcccgcaag

SEQ ID NO: 2339 - DNA, 27 bp, Artificial Sequence
  Description of Artificial Sequence: Synthetic oligonucleotide
aagtttccttctctggagcttcccgca

SEQ ID NO: 2340 - DNA, 27 bp, Artificial Sequence
  Description of Artificial Sequence: Synthetic oligonucleotide
agcttcccgcaggtgggcagctagctg

SEQ ID NO: 2341 - DNA, 27 bp, Artificial Sequence
  Description of Artificial Sequence: Synthetic oligonucleotide
gtgggcagctagctgcagcgactaccg

SEQ ID NO: 2342 - DNA, 27 bp, Artificial Sequence
  Description of Artificial Sequence: Synthetic oligonucleotide
aagtgcagttagggctgggaagggtct

SEQ ID NO: 2343 - DNA, 27 bp, Artificial Sequence
  Description of Artificial Sequence: Synthetic oligonucleotide
agtgcagttagggctgggaagggtcta

SEQ ID NO: 2344 - DNA, 27 bp, Artificial Sequence
  Description of Artificial Sequence: Synthetic oligonucleotide
gtgcagttagggctgggaagggtctac

SEQ ID NO: 2345 - DNA, 27 bp, Artificial Sequence
  Description of Artificial Sequence: Synthetic oligonucleotide
tgcagttagggctgggaagggtctacc

SEQ ID NO: 2346 - DNA, 27 bp, Artificial Sequence
  Description of Artificial Sequence: Synthetic oligonucleotide
gcagttagggctgggaagggtctaccc

SEQ ID NO: 2347 - DNA, 27 bp, Artificial Sequence
  Description of Artificial Sequence: Synthetic oligonucleotide
cagttagggctgggaagggtctaccct

SEQ ID NO: 2348 - DNA, 27 bp, Artificial Sequence
  Description of Artificial Sequence: Synthetic oligonucleotide
agttagggctgggaagggtctaccctc

SEQ ID NO: 2349 - DNA, 27 bp, Artificial Sequence
  Description of Artificial Sequence: Synthetic oligonucleotide
gttagggctgggaagggtctaccctcg

SEQ ID NO: 2350 - DNA, 27 bp, Artificial Sequence
  Description of Artificial Sequence: Synthetic oligonucleotide
ttagggctgggaagggtctaccctcgg

SEQ ID NO: 2351 - DNA, 27 bp, Artificial Sequence
  Description of Artificial Sequence: Synthetic oligonucleotide
tagggctgggaagggtctaccctcggc

SEQ ID NO: 2352 - DNA, 27 bp, Artificial Sequence
  Description of Artificial Sequence: Synthetic oligonucleotide
agggctgggaagggtctaccctcggcc

SEQ ID NO: 2353 - DNA, 27 bp, Artificial Sequence
  Description of Artificial Sequence: Synthetic oligonucleotide
ctttccagaatctgttccagagcgtgc

SEQ ID NO: 2354 - DNA, 27 bp, Artificial Sequence
  Description of Artificial Sequence: Synthetic oligonucleotide
tttccagaatctgttccagagcgtgcg

SEQ ID NO: 2355 - DNA, 27 bp, Artificial Sequence
  Description of Artificial Sequence: Synthetic oligonucleotide
ttccagaatctgttccagagcgtgcgc

SEQ ID NO: 2356 - DNA, 27 bp, Artificial Sequence
  Description of Artificial Sequence: Synthetic oligonucleotide
tccagaatctgttccagagcgtgcgcg

SEQ ID NO: 2357 - DNA, 27 bp, Artificial Sequence
  Description of Artificial Sequence: Synthetic oligonucleotide
ccagaatctgttccagagcgtgcgcga

SEQ ID NO: 2358 - DNA, 27 bp, Artificial Sequence
  Description of Artificial Sequence: Synthetic oligonucleotide
cagaatctgttccagagcgtgcgcgaa

SEQ ID NO: 2359 - DNA, 27 bp, Artificial Sequence
  Description of Artificial Sequence: Synthetic oligonucleotide
agaatctgttccagagcgtgcgcgaag

SEQ ID NO: 2360 - DNA, 27 bp, Artificial Sequence
  Description of Artificial Sequence: Synthetic oligonucleotide
gaatctgttccagagcgtgcgcgaagt

SEQ ID NO: 2361 - DNA, 27 bp, Artificial Sequence
  Description of Artificial Sequence: Synthetic oligonucleotide
aatctgttccagagcgtgcgcgaagtg

SEQ ID NO: 2362 - DNA, 27 bp, Artificial Sequence
  Description of Artificial Sequence: Synthetic oligonucleotide
atctgttccagagcgtgcgcgaagtga

SEQ ID NO: 2363 - DNA, 27 bp, Artificial Sequence
  Description of Artificial Sequence: Synthetic oligonucleotide
tctgttccagagcgtgcgcgaagtgat

SEQ ID NO: 2364 - DNA, 27 bp, Artificial Sequence
  Description of Artificial Sequence: Synthetic oligonucleotide
ctgttccagagcgtgcgcgaagtgatc

SEQ ID NO: 2365 - DNA, 27 bp, Artificial Sequence
  Description of Artificial Sequence: Synthetic oligonucleotide
tgttccagagcgtgcgcgaagtgatcc

SEQ ID NO: 2366 - DNA, 27 bp, Artificial Sequence
  Description of Artificial Sequence: Synthetic oligonucleotide
ggcgccagtttgctgctgctgcagcag

SEQ ID NO: 2367 - DNA, 27 bp, Artificial Sequence
  Description of Artificial Sequence: Synthetic oligonucleotide
ttgctgctgctgcagcagcagcagcag

SEQ ID NO: 2368 - DNA, 27 bp, Artificial Sequence
  Description of Artificial Sequence: Synthetic oligonucleotide
gcgtcccagagcctggagccgccgtgg

SEQ ID NO: 2369 - DNA, 27 bp, Artificial Sequence
  Description of Artificial Sequence: Synthetic oligonucleotide
ggctgccgcagcagctgccagcacctc

SEQ ID NO: 2370 - DNA, 27 bp, Artificial Sequence
  Description of Artificial Sequence: Synthetic oligonucleotide
cgcagcagctgccagcacctccggacg

SEQ ID NO: 2371 - DNA, 27 bp, Artificial Sequence
  Description of Artificial Sequence: Synthetic oligonucleotide
cccatccacgttgtccctgctgggccc

SEQ ID NO: 2372 - DNA, 27 bp, Artificial Sequence
  Description of Artificial Sequence: Synthetic oligonucleotide
ccggcttaagcagctgctccgctgacc

SEQ ID NO: 2373 - DNA, 27 bp, Artificial Sequence
  Description of Artificial Sequence: Synthetic oligonucleotide
cggcttaagcagctgctccgctgacct

SEQ ID NO: 2374 - DNA, 27 bp, Artificial Sequence
  Description of Artificial Sequence: Synthetic oligonucleotide
taagcagctgctccgctgaccttaaag

SEQ ID NO: 2375 - DNA, 27 bp, Artificial Sequence
  Description of Artificial Sequence: Synthetic oligonucleotide
atgcaactccttcagcaacagcagcag

SEQ ID NO: 2376 - DNA, 27 bp, Artificial Sequence
  Description of Artificial Sequence: Synthetic oligonucleotide
accatttctgacaacgccaaggagttg

SEQ ID NO: 2377 - DNA, 27 bp, Artificial Sequence
  Description of Artificial Sequence: Synthetic oligonucleotide
ccacttttgggagttccacccgctgtg

SEQ ID NO: 2378 - DNA, 27 bp, Artificial Sequence
  Description of Artificial Sequence: Synthetic oligonucleotide
caggcaagagcactgaagatactgctg

SEQ ID NO: 2379 - DNA, 27 bp, Artificial Sequence
  Description of Artificial Sequence: Synthetic oligonucleotide
ctggcagcgctgcagcagggagctccg

SEQ ID NO: 2380 - DNA, 27 bp, Artificial Sequence
  Description of Artificial Sequence: Synthetic oligonucleotide
agtcgcgactactacaactttccactg

SEQ ID NO: 2381 - DNA, 27 bp, Artificial Sequence
  Description of Artificial Sequence: Synthetic oligonucleotide
gtcgcgactactacaactttccactgg

SEQ ID NO: 2382 - DNA, 27 bp, Artificial Sequence
  Description of Artificial Sequence: Synthetic oligonucleotide
tcgcgactactacaactttccactggc

SEQ ID NO: 2383 - DNA, 27 bp, Artificial Sequence
  Description of Artificial Sequence: Synthetic oligonucleotide
gctcgcatcaagctggagaacccgctg

SEQ ID NO: 2384 - DNA, 27 bp, Artificial Sequence
  Description of Artificial Sequence: Synthetic oligonucleotide
gctggactacggcagcgcctgggcggc

SEQ ID NO: 2385 - DNA, 27 bp, Artificial Sequence
  Description of Artificial Sequence: Synthetic oligonucleotide
ctggactacggcagcgcctgggcggct

SEQ ID NO: 2386 - DNA, 27 bp, Artificial Sequence
  Description of Artificial Sequence: Synthetic oligonucleotide
tggactacggcagcgcctgggcggctg

SEQ ID NO: 2387 - DNA, 27 bp, Artificial Sequence
  Description of Artificial Sequence: Synthetic oligonucleotide
ggactacggcagcgcctgggcggctgc

SEQ ID NO: 2388 - DNA, 27 bp, Artificial Sequence
  Description of Artificial Sequence: Synthetic oligonucleotide
tggcgcgggtgcagcgggacccggttc

SEQ ID NO: 2389 - DNA, 27 bp, Artificial Sequence
  Description of Artificial Sequence: Synthetic oligonucleotide
ggctggcgggccaggaaagcgacttca

SEQ ID NO: 2390 - DNA, 27 bp, Artificial Sequence
  Description of Artificial Sequence: Synthetic oligonucleotide
gtaccctggcggcatggtgagcagagt

SEQ ID NO: 2391 - DNA, 27 bp, Artificial Sequence
  Description of Artificial Sequence: Synthetic oligonucleotide
tggatggatagctactccggaccttac

SEQ ID NO: 2392 - DNA, 27 bp, Artificial Sequence
  Description of Artificial Sequence: Synthetic oligonucleotide
cccagaagacctgcctgatctgtggag

SEQ ID NO: 2393 - DNA, 27 bp, Artificial Sequence
  Description of Artificial Sequence: Synthetic oligonucleotide
ccagaagacctgcctgatctgtggaga

SEQ ID NO: 2394 - DNA, 27 bp, Artificial Sequence
  Description of Artificial Sequence: Synthetic oligonucleotide
cagaagacctgcctgatctgtggagat

SEQ ID NO: 2395 - DNA, 27 bp, Artificial Sequence
  Description of Artificial Sequence: Synthetic oligonucleotide
agaagacctgcctgatctgtggagatg

SEQ ID NO: 2396 - DNA, 27 bp, Artificial Sequence
  Description of Artificial Sequence: Synthetic oligonucleotide
gaagacctgcctgatctgtggagatga

SEQ ID NO: 2397 - DNA, 27 bp, Artificial Sequence
  Description of Artificial Sequence: Synthetic oligonucleotide
aagacctgcctgatctgtggagatgaa

SEQ ID NO: 2398 - DNA, 27 bp, Artificial Sequence
  Description of Artificial Sequence: Synthetic oligonucleotide
agacctgcctgatctgtggagatgaag

SEQ ID NO: 2399 - DNA, 27 bp, Artificial Sequence
  Description of Artificial Sequence: Synthetic oligonucleotide
gacctgcctgatctgtggagatgaagc

SEQ ID NO: 2400 - DNA, 27 bp, Artificial Sequence
  Description of Artificial Sequence: Synthetic oligonucleotide
acctgcctgatctgtggagatgaagct

SEQ ID NO: 2401 - DNA, 27 bp, Artificial Sequence
  Description of Artificial Sequence: Synthetic oligonucleotide
cctgcctgatctgtggagatgaagctt

SEQ ID NO: 2402 - DNA, 27 bp, Artificial Sequence
  Description of Artificial Sequence: Synthetic oligonucleotide
ctgcctgatctgtggagatgaagcttc

SEQ ID NO: 2403 - DNA, 27 bp, Artificial Sequence
  Description of Artificial Sequence: Synthetic oligonucleotide
tgcctgatctgtggagatgaagcttct

SEQ ID NO: 2404 - DNA, 27 bp, Artificial Sequence
  Description of Artificial Sequence: Synthetic oligonucleotide
gcctgatctgtggagatgaagcttctg

SEQ ID NO: 2405 - DNA, 27 bp, Artificial Sequence
  Description of Artificial Sequence: Synthetic oligonucleotide
cctgatctgtggagatgaagcttctgg

SEQ ID NO: 2406 - DNA, 27 bp, Artificial Sequence
  Description of Artificial Sequence: Synthetic oligonucleotide
ctgatctgtggagatgaagcttctggg

SEQ ID NO: 2407 - DNA, 27 bp, Artificial Sequence
  Description of Artificial Sequence: Synthetic oligonucleotide
tgatctgtggagatgaagcttctgggt

SEQ ID NO: 2408 - DNA, 27 bp, Artificial Sequence
  Description of Artificial Sequence: Synthetic oligonucleotide
gatctgtggagatgaagcttctgggtg

SEQ ID NO: 2409 - DNA, 27 bp, Artificial Sequence
  Description of Artificial Sequence: Synthetic oligonucleotide
atctgtggagatgaagcttctgggtgt

SEQ ID NO: 2410 - DNA, 27 bp, Artificial Sequence
  Description of Artificial Sequence: Synthetic oligonucleotide
tctgtggagatgaagcttctgggtgtc

SEQ ID NO: 2411 - DNA, 27 bp, Artificial Sequence
  Description of Artificial Sequence: Synthetic oligonucleotide
ctgtggagatgaagcttctgggtgtca

SEQ ID NO: 2412 - DNA, 27 bp, Artificial Sequence
  Description of Artificial Sequence: Synthetic oligonucleotide
gcttctgggtgtcactatggagctctc

SEQ ID NO: 2413 - DNA, 27 bp, Artificial Sequence
  Description of Artificial Sequence: Synthetic oligonucleotide
tggagctctcacatgtggaagctgcaa

SEQ ID NO: 2414 - DNA, 27 bp, Artificial Sequence
  Description of Artificial Sequence: Synthetic oligonucleotide
gaagctgcaaggtcttcttcaaaagag

SEQ ID NO: 2415 - DNA, 27 bp, Artificial Sequence
  Description of Artificial Sequence: Synthetic oligonucleotide
aagctgcaaggtcttcttcaaaagagc

SEQ ID NO: 2416 - DNA, 27 bp, Artificial Sequence
  Description of Artificial Sequence: Synthetic oligonucleotide
agctgcaaggtcttcttcaaaagagcc

SEQ ID NO: 2417 - DNA, 27 bp, Artificial Sequence
  Description of Artificial Sequence: Synthetic oligonucleotide
gctgcaaggtcttcttcaaaagagccg

SEQ ID NO: 2418 - DNA, 27 bp, Artificial Sequence
  Description of Artificial Sequence: Synthetic oligonucleotide
ctgcaaggtcttcttcaaaagagccgc

SEQ ID NO: 2419 - DNA, 27 bp, Artificial Sequence
  Description of Artificial Sequence: Synthetic oligonucleotide
tgcaaggtcttcttcaaaagagccgct

SEQ ID NO: 2420 - DNA, 27 bp, Artificial Sequence
  Description of Artificial Sequence: Synthetic oligonucleotide
gcaaggtcttcttcaaaagagccgctg

SEQ ID NO: 2421 - DNA, 27 bp, Artificial Sequence
  Description of Artificial Sequence: Synthetic oligonucleotide
caaggtcttcttcaaaagagccgctga

SEQ ID NO: 2422 - DNA, 27 bp, Artificial Sequence
  Description of Artificial Sequence: Synthetic oligonucleotide
aaggtcttcttcaaaagagccgctgaa

SEQ ID NO: 2423 - DNA, 27 bp, Artificial Sequence
  Description of Artificial Sequence: Synthetic oligonucleotide
aggtcttcttcaaaagagccgctgaag

SEQ ID NO: 2424 - DNA, 27 bp, Artificial Sequence
  Description of Artificial Sequence: Synthetic oligonucleotide
ggtcttcttcaaaagagccgctgaagg

SEQ ID NO: 2425 - DNA, 27 bp, Artificial Sequence
  Description of Artificial Sequence: Synthetic oligonucleotide
gtcttcttcaaaagagccgctgaaggg

SEQ ID NO: 2426 - DNA, 27 bp, Artificial Sequence
  Description of Artificial Sequence: Synthetic oligonucleotide
tcttcttcaaaagagccgctgaaggga

SEQ ID NO: 2427 - DNA, 27 bp, Artificial Sequence
  Description of Artificial Sequence: Synthetic oligonucleotide
cttcttcaaaagagccgctgaagggaa

SEQ ID NO: 2428 - DNA, 27 bp, Artificial Sequence
  Description of Artificial Sequence: Synthetic oligonucleotide
ttcttcaaaagagccgctgaagggaaa

SEQ ID NO: 2429 - DNA, 27 bp, Artificial Sequence
  Description of Artificial Sequence: Synthetic oligonucleotide
tcttcaaaagagccgctgaagggaaac

SEQ ID NO: 2430 - DNA, 27 bp, Artificial Sequence
  Description of Artificial Sequence: Synthetic oligonucleotide
cttcaaaagagccgctgaagggaaaca

SEQ ID NO: 2431 - DNA, 27 bp, Artificial Sequence
  Description of Artificial Sequence: Synthetic oligonucleotide
ttcaaaagagccgctgaagggaaacag

SEQ ID NO: 2432 - DNA, 27 bp, Artificial Sequence
  Description of Artificial Sequence: Synthetic oligonucleotide
tcaaaagagccgctgaagggaaacaga

SEQ ID NO: 2433 - DNA, 27 bp, Artificial Sequence
  Description of Artificial Sequence: Synthetic oligonucleotide
caaaagagccgctgaagggaaacagaa

SEQ ID NO: 2434 - DNA, 27 bp, Artificial Sequence
  Description of Artificial Sequence: Synthetic oligonucleotide
aaaagagccgctgaagggaaacagaag

SEQ ID NO: 2435 - DNA, 27 bp, Artificial Sequence
  Description of Artificial Sequence: Synthetic oligonucleotide
aaagagccgctgaagggaaacagaagt

SEQ ID NO: 2436 - DNA, 27 bp, Artificial Sequence
  Description of Artificial Sequence: Synthetic oligonucleotide
aagagccgctgaagggaaacagaagta

SEQ ID NO: 2437 - DNA, 27 bp, Artificial Sequence
  Description of Artificial Sequence: Synthetic oligonucleotide
agagccgctgaagggaaacagaagtac

SEQ ID NO: 2438 - DNA, 27 bp, Artificial Sequence
  Description of Artificial Sequence: Synthetic oligonucleotide
gagccgctgaagggaaacagaagtacc

SEQ ID NO: 2439 - DNA, 27 bp, Artificial Sequence
  Description of Artificial Sequence: Synthetic oligonucleotide
agccgctgaagggaaacagaagtacct

SEQ ID NO: 2440 - DNA, 27 bp, Artificial Sequence
  Description of Artificial Sequence: Synthetic oligonucleotide
ccgctgaagggaaacagaagtacctgt

SEQ ID NO: 2441 - DNA, 27 bp, Artificial Sequence
  Description of Artificial Sequence: Synthetic oligonucleotide
cgctgaagggaaacagaagtacctgtg

SEQ ID NO: 2442 - DNA, 27 bp, Artificial Sequence
  Description of Artificial Sequence: Synthetic oligonucleotide
cctgtgcgccagcagaaatgattgcac

SEQ ID NO: 2443 - DNA, 27 bp, Artificial Sequence
  Description of Artificial Sequence: Synthetic oligonucleotide
gcagaaatgattgcactattgataaat

SEQ ID NO: 2444 - DNA, 27 bp, Artificial Sequence
  Description of Artificial Sequence: Synthetic oligonucleotide
aatgattgcactattgataaattccga

SEQ ID NO: 2445 - DNA, 27 bp, Artificial Sequence
  Description of Artificial Sequence: Synthetic oligonucleotide
cactattgataaattccgaaggaaaaa

SEQ ID NO: 2446 - DNA, 27 bp, Artificial Sequence
  Description of Artificial Sequence: Synthetic oligonucleotide
ttcggaaatgttatgaagcagggatga

SEQ ID NO: 2447 - DNA, 27 bp, Artificial Sequence
  Description of Artificial Sequence: Synthetic oligonucleotide
tcggaaatgttatgaagcagggatgac

SEQ ID NO: 2448 - DNA, 27 bp, Artificial Sequence
  Description of Artificial Sequence: Synthetic oligonucleotide
cggaaatgttatgaagcagggatgact

SEQ ID NO: 2449 - DNA, 27 bp, Artificial Sequence
  Description of Artificial Sequence: Synthetic oligonucleotide
ggaaatgttatgaagcagggatgactc

SEQ ID NO: 2450 - DNA, 27 bp, Artificial Sequence
  Description of Artificial Sequence: Synthetic oligonucleotide
gaaatgttatgaagcagggatgactct

SEQ ID NO: 2451 - DNA, 27 bp, Artificial Sequence
  Description of Artificial Sequence: Synthetic oligonucleotide
aaatgttatgaagcagggatgactctg

SEQ ID NO: 2452 - DNA, 27 bp, Artificial Sequence
  Description of Artificial Sequence: Synthetic oligonucleotide
aatgttatgaagcagggatgactctgg

SEQ ID NO: 2453 - DNA, 27 bp, Artificial Sequence
  Description of Artificial Sequence: Synthetic oligonucleotide
atgttatgaagcagggatgactctggg

SEQ ID NO: 2454 - DNA, 27 bp, Artificial Sequence
  Description of Artificial Sequence: Synthetic oligonucleotide
tgttatgaagcagggatgactctggga

SEQ ID NO: 2455 - DNA, 27 bp, Artificial Sequence
  Description of Artificial Sequence: Synthetic oligonucleotide
gttatgaagcagggatgactctgggag

SEQ ID NO: 2456 - DNA, 27 bp, Artificial Sequence
  Description of Artificial Sequence: Synthetic oligonucleotide
ttatgaagcagggatgactctgggagc

SEQ ID NO: 2457 - DNA, 27 bp, Artificial Sequence
  Description of Artificial Sequence: Synthetic oligonucleotide
tatgaagcagggatgactctgggagcc

SEQ ID NO: 2458 - DNA, 27 bp, Artificial Sequence
  Description of Artificial Sequence: Synthetic oligonucleotide
atgaagcagggatgactctgggagccc

SEQ ID NO: 2459 - DNA, 27 bp, Artificial Sequence
  Description of Artificial Sequence: Synthetic oligonucleotide
tgaagcagggatgactctgggagcccg

SEQ ID NO: 2460 - DNA, 27 bp, Artificial Sequence
  Description of Artificial Sequence: Synthetic oligonucleotide
gaagcagggatgactctgggagcccgg

SEQ ID NO: 2461 - DNA, 27 bp, Artificial Sequence
  Description of Artificial Sequence: Synthetic oligonucleotide
aagcagggatgactctgggagcccgga

SEQ ID NO: 2462 - DNA, 27 bp, Artificial Sequence
  Description of Artificial Sequence: Synthetic oligonucleotide
agcagggatgactctgggagcccggaa

SEQ ID NO: 2463 - DNA, 27 bp, Artificial Sequence
  Description of Artificial Sequence: Synthetic oligonucleotide
ctgaagaaacttggtaatctgaaacta

SEQ ID NO: 2464 - DNA, 27 bp, Artificial Sequence
  Description of Artificial Sequence: Synthetic oligonucleotide
tgaaactacaggaggaaggagaggctt

SEQ ID NO: 2465 - DNA, 27 bp, Artificial Sequence
  Description of Artificial Sequence: Synthetic oligonucleotide
gaaactacaggaggaaggagaggcttc

SEQ ID NO: 2466 - DNA, 27 bp, Artificial Sequence
  Description of Artificial Sequence: Synthetic oligonucleotide
cacattgaaggctatgaatgtcagccc

SEQ ID NO: 2467 - DNA, 27 bp, Artificial Sequence
  Description of Artificial Sequence: Synthetic oligonucleotide
acattgaaggctatgaatgtcagccca

SEQ ID NO: 2468 - DNA, 27 bp, Artificial Sequence
  Description of Artificial Sequence: Synthetic oligonucleotide
cattgaaggctatgaatgtcagcccat

SEQ ID NO: 2469 - DNA, 27 bp, Artificial Sequence
  Description of Artificial Sequence: Synthetic oligonucleotide
attgaaggctatgaatgtcagcccatc

SEQ ID NO: 2470 - DNA, 27 bp, Artificial Sequence
  Description of Artificial Sequence: Synthetic oligonucleotide
ttgaaggctatgaatgtcagcccatct

SEQ ID NO: 2471 - DNA, 27 bp, Artificial Sequence
  Description of Artificial Sequence: Synthetic oligonucleotide
tgaaggctatgaatgtcagcccatctt

SEQ ID NO: 2472 - DNA, 27 bp, Artificial Sequence
  Description of Artificial Sequence: Synthetic oligonucleotide
atgtcctggaagccattgagccaggtg

SEQ ID NO: 2473 - DNA, 27 bp, Artificial Sequence
  Description of Artificial Sequence: Synthetic oligonucleotide
tgtcctggaagccattgagccaggtgt

SEQ ID NO: 2474 - DNA, 27 bp, Artificial Sequence
  Description of Artificial Sequence: Synthetic oligonucleotide
gtcctggaagccattgagccaggtgta

SEQ ID NO: 2475 - DNA, 27 bp, Artificial Sequence
  Description of Artificial Sequence: Synthetic oligonucleotide
tcctggaagccattgagccaggtgtag

SEQ ID NO: 2476 - DNA, 27 bp, Artificial Sequence
  Description of Artificial Sequence: Synthetic oligonucleotide
cctggaagccattgagccaggtgtagt

SEQ ID NO: 2477 - DNA, 27 bp, Artificial Sequence
  Description of Artificial Sequence: Synthetic oligonucleotide
accagcccgactcctttgcagccttgc

SEQ ID NO: 2478 - DNA, 27 bp, Artificial Sequence
  Description of Artificial Sequence: Synthetic oligonucleotide
ccgactcctttgcagccttgctctcta

SEQ ID NO: 2479 - DNA, 27 bp, Artificial Sequence
  Description of Artificial Sequence: Synthetic oligonucleotide
tgcagccttgctctctagcctcaatga

SEQ ID NO: 2480 - DNA, 27 bp, Artificial Sequence
  Description of Artificial Sequence: Synthetic oligonucleotide
acgtggtcaagtgggccaaggccttgc

SEQ ID NO: 2481 - DNA, 27 bp, Artificial Sequence
  Description of Artificial Sequence: Synthetic oligonucleotide
cgtggtcaagtgggccaaggccttgcc

SEQ ID NO: 2482 - DNA, 27 bp, Artificial Sequence
  Description of Artificial Sequence: Synthetic oligonucleotide
gtggtcaagtgggccaaggccttgcct

SEQ ID NO: 2483 - DNA, 27 bp, Artificial Sequence
  Description of Artificial Sequence: Synthetic oligonucleotide
tggtcaagtgggccaaggccttgcctg

SEQ ID NO: 2484 - DNA, 27 bp, Artificial Sequence
  Description of Artificial Sequence: Synthetic oligonucleotide
ggtcaagtgggccaaggccttgcctgg

SEQ ID NO: 2485 - DNA, 27 bp, Artificial Sequence
  Description of Artificial Sequence: Synthetic oligonucleotide
gtcaagtgggccaaggccttgcctggc

SEQ ID NO: 2486 - DNA, 27 bp, Artificial Sequence
  Description of Artificial Sequence: Synthetic oligonucleotide
tcaagtgggccaaggccttgcctggct

SEQ ID NO: 2487 - DNA, 27 bp, Artificial Sequence
  Description of Artificial Sequence: Synthetic oligonucleotide
caagtgggccaaggccttgcctggctt

SEQ ID NO: 2488 - DNA, 27 bp, Artificial Sequence
  Description of Artificial Sequence: Synthetic oligonucleotide
aagtgggccaaggccttgcctggcttc

SEQ ID NO: 2489 - DNA, 27 bp, Artificial Sequence
  Description of Artificial Sequence: Synthetic oligonucleotide
agtgggccaaggccttgcctggcttcc

SEQ ID NO: 2490 - DNA, 27 bp, Artificial Sequence
  Description of Artificial Sequence: Synthetic oligonucleotide
gtgggccaaggccttgcctggcttccg

SEQ ID NO: 2491 - DNA, 27 bp, Artificial Sequence
  Description of Artificial Sequence: Synthetic oligonucleotide
tgggccaaggccttgcctggcttccgc

SEQ ID NO: 2492 - DNA, 27 bp, Artificial Sequence
  Description of Artificial Sequence: Synthetic oligonucleotide
gggccaaggccttgcctggcttccgca

SEQ ID NO: 2493 - DNA, 27 bp, Artificial Sequence
  Description of Artificial Sequence: Synthetic oligonucleotide
ggccaaggccttgcctggcttccgcaa

SEQ ID NO: 2494 - DNA, 27 bp, Artificial Sequence
  Description of Artificial Sequence: Synthetic oligonucleotide
gccaaggccttgcctggcttccgcaac

SEQ ID NO: 2495 - DNA, 27 bp, Artificial Sequence
  Description of Artificial Sequence: Synthetic oligonucleotide
ccaaggccttgcctggcttccgcaact

SEQ ID NO: 2496 - DNA, 27 bp, Artificial Sequence
  Description of Artificial Sequence: Synthetic oligonucleotide
caaggccttgcctggcttccgcaactt

SEQ ID NO: 2497 - DNA, 27 bp, Artificial Sequence
  Description of Artificial Sequence: Synthetic oligonucleotide
aaggccttgcctggcttccgcaactta

SEQ ID NO: 2498 - DNA, 27 bp, Artificial Sequence
  Description of Artificial Sequence: Synthetic oligonucleotide
aggccttgcctggcttccgcaacttac

SEQ ID NO: 2499 - DNA, 27 bp, Artificial Sequence
  Description of Artificial Sequence: Synthetic oligonucleotide
ggccttgcctggcttccgcaacttaca

SEQ ID NO: 2500 - DNA, 27 bp, Artificial Sequence
  Description of Artificial Sequence: Synthetic oligonucleotide
gccttgcctggcttccgcaacttacac

SEQ ID NO: 2501 - DNA, 27 bp, Artificial Sequence
  Description of Artificial Sequence: Synthetic oligonucleotide
ccttgcctggcttccgcaacttacacg

SEQ ID NO: 2502 - DNA, 27 bp, Artificial Sequence
  Description of Artificial Sequence: Synthetic oligonucleotide
cttgcctggcttccgcaacttacacgt

SEQ ID NO: 2503 - DNA, 27 bp, Artificial Sequence
  Description of Artificial Sequence: Synthetic oligonucleotide
ccaatgtcaactccaggatgctctact

SEQ ID NO: 2504 - DNA, 27 bp, Artificial Sequence
  Description of Artificial Sequence: Synthetic oligonucleotide
caatgtcaactccaggatgctctactt

SEQ ID NO: 2505 - DNA, 27 bp, Artificial Sequence
  Description of Artificial Sequence: Synthetic oligonucleotide
aatgtcaactccaggatgctctacttc

SEQ ID NO: 2506 - DNA, 27 bp, Artificial Sequence
  Description of Artificial Sequence: Synthetic oligonucleotide
atgtcaactccaggatgctctacttcg

SEQ ID NO: 2507 - DNA, 27 bp, Artificial Sequence
  Description of Artificial Sequence: Synthetic oligonucleotide
tgtcaactccaggatgctctacttcgc

SEQ ID NO: 2508 - DNA, 27 bp, Artificial Sequence
  Description of Artificial Sequence: Synthetic oligonucleotide
gtcaactccaggatgctctacttcgcc

SEQ ID NO: 2509 - DNA, 27 bp, Artificial Sequence
  Description of Artificial Sequence: Synthetic oligonucleotide
tcaactccaggatgctctacttcgccc

SEQ ID NO: 2510 - DNA, 27 bp, Artificial Sequence
  Description of Artificial Sequence: Synthetic oligonucleotide
tctggttttcaatgagtaccgcatgca

SEQ ID NO: 2511 - DNA, 27 bp, Artificial Sequence
  Description of Artificial Sequence: Synthetic oligonucleotide
ctggttttcaatgagtaccgcatgcac

SEQ ID NO: 2512 - DNA, 27 bp, Artificial Sequence
  Description of Artificial Sequence: Synthetic oligonucleotide
tggttttcaatgagtaccgcatgcaca

SEQ ID NO: 2513 - DNA, 27 bp, Artificial Sequence
  Description of Artificial Sequence: Synthetic oligonucleotide
ggttttcaatgagtaccgcatgcacaa

SEQ ID NO: 2514 - DNA, 27 bp, Artificial Sequence
  Description of Artificial Sequence: Synthetic oligonucleotide
gttttcaatgagtaccgcatgcacaag

SEQ ID NO: 2515 - DNA, 27 bp, Artificial Sequence
  Description of Artificial Sequence: Synthetic oligonucleotide
ttttcaatgagtaccgcatgcacaagt

SEQ ID NO: 2516 - DNA, 27 bp, Artificial Sequence
  Description of Artificial Sequence: Synthetic oligonucleotide
tttcaatgagtaccgcatgcacaagtc

SEQ ID NO: 2517 - DNA, 27 bp, Artificial Sequence
  Description of Artificial Sequence: Synthetic oligonucleotide
ttcaatgagtaccgcatgcacaagtcc

SEQ ID NO: 2518 - DNA, 27 bp, Artificial Sequence
  Description of Artificial Sequence: Synthetic oligonucleotide
tcaatgagtaccgcatgcacaagtccc

SEQ ID NO: 2519 - DNA, 27 bp, Artificial Sequence
  Description of Artificial Sequence: Synthetic oligonucleotide
caatgagtaccgcatgcacaagtcccg

SEQ ID NO: 2520 - DNA, 27 bp, Artificial Sequence
  Description of Artificial Sequence: Synthetic oligonucleotide
aatgagtaccgcatgcacaagtcccgg

SEQ ID NO: 2521 - DNA, 27 bp, Artificial Sequence
  Description of Artificial Sequence: Synthetic oligonucleotide
atgagtaccgcatgcacaagtcccgga

SEQ ID NO: 2522 - DNA, 27 bp, Artificial Sequence
  Description of Artificial Sequence: Synthetic oligonucleotide
tgagtaccgcatgcacaagtcccggat

SEQ ID NO: 2523 - DNA, 27 bp, Artificial Sequence
  Description of Artificial Sequence: Synthetic oligonucleotide
tctctcaagagtttggatggctccaaa

SEQ ID NO: 2524 - DNA, 27 bp, Artificial Sequence
  Description of Artificial Sequence: Synthetic oligonucleotide
ctctcaagagtttggatggctccaaat

SEQ ID NO: 2525 - DNA, 27 bp, Artificial Sequence
  Description of Artificial Sequence: Synthetic oligonucleotide
tctcaagagtttggatggctccaaatc

SEQ ID NO: 2526 - DNA, 27 bp, Artificial Sequence
  Description of Artificial Sequence: Synthetic oligonucleotide
ctcaagagtttggatggctccaaatca

SEQ ID NO: 2527 - DNA, 27 bp, Artificial Sequence
  Description of Artificial Sequence: Synthetic oligonucleotide
tcaagagtttggatggctccaaatcac

SEQ ID NO: 2528 - DNA, 27 bp, Artificial Sequence
  Description of Artificial Sequence: Synthetic oligonucleotide
caagagtttggatggctccaaatcacc

SEQ ID NO: 2529 - DNA, 27 bp, Artificial Sequence
  Description of Artificial Sequence: Synthetic oligonucleotide
aagagtttggatggctccaaatcaccc

SEQ ID NO: 2530 - DNA, 27 bp, Artificial Sequence
  Description of Artificial Sequence: Synthetic oligonucleotide
cccaggaattcctgtgcatgaaagcac

SEQ ID NO: 2531 - DNA, 27 bp, Artificial Sequence
  Description of Artificial Sequence: Synthetic oligonucleotide
ccaggaattcctgtgcatgaaagcact

SEQ ID NO: 2532 - DNA, 27 bp, Artificial Sequence
  Description of Artificial Sequence: Synthetic oligonucleotide
caggaattcctgtgcatgaaagcactg

SEQ ID NO: 2533 - DNA, 27 bp, Artificial Sequence
  Description of Artificial Sequence: Synthetic oligonucleotide
aggaattcctgtgcatgaaagcactgc

SEQ ID NO: 2534 - DNA, 27 bp, Artificial Sequence
  Description of Artificial Sequence: Synthetic oligonucleotide
ggaattcctgtgcatgaaagcactgct

SEQ ID NO: 2535 - DNA, 27 bp, Artificial Sequence
  Description of Artificial Sequence: Synthetic oligonucleotide
gaattcctgtgcatgaaagcactgcta

SEQ ID NO: 2536 - DNA, 27 bp, Artificial Sequence
  Description of Artificial Sequence: Synthetic oligonucleotide
aattcctgtgcatgaaagcactgctac

SEQ ID NO: 2537 - DNA, 27 bp, Artificial Sequence
  Description of Artificial Sequence: Synthetic oligonucleotide
attcctgtgcatgaaagcactgctact

SEQ ID NO: 2538 - DNA, 27 bp, Artificial Sequence
  Description of Artificial Sequence: Synthetic oligonucleotide
ttcctgtgcatgaaagcactgctactc

SEQ ID NO: 2539 - DNA, 27 bp, Artificial Sequence
  Description of Artificial Sequence: Synthetic oligonucleotide
tcctgtgcatgaaagcactgctactct

SEQ ID NO: 2540 - DNA, 27 bp, Artificial Sequence
  Description of Artificial Sequence: Synthetic oligonucleotide
cctgtgcatgaaagcactgctactctt

SEQ ID NO: 2541 - DNA, 27 bp, Artificial Sequence
  Description of Artificial Sequence: Synthetic oligonucleotide
tactcttcagcattattccagtggatg

SEQ ID NO: 2542 - DNA, 27 bp, Artificial Sequence
  Description of Artificial Sequence: Synthetic oligonucleotide
actcttcagcattattccagtggatgg

SEQ ID NO: 2543 - DNA, 27 bp, Artificial Sequence
  Description of Artificial Sequence: Synthetic oligonucleotide
ctcttcagcattattccagtggatggg

SEQ ID NO: 2544 - DNA, 27 bp, Artificial Sequence
  Description of Artificial Sequence: Synthetic oligonucleotide
tcttcagcattattccagtggatgggc

SEQ ID NO: 2545 - DNA, 27 bp, Artificial Sequence
  Description of Artificial Sequence: Synthetic oligonucleotide
cttcagcattattccagtggatgggct

SEQ ID NO: 2546 - DNA, 27 bp, Artificial Sequence
  Description of Artificial Sequence: Synthetic oligonucleotide
ttcagcattattccagtggatgggctg

SEQ ID NO: 2547 - DNA, 27 bp, Artificial Sequence
  Description of Artificial Sequence: Synthetic oligonucleotide
tcagcattattccagtggatgggctga

SEQ ID NO: 2548 - DNA, 27 bp, Artificial Sequence
  Description of Artificial Sequence: Synthetic oligonucleotide
cagcattattccagtggatgggctgaa

SEQ ID NO: 2549 - DNA, 27 bp, Artificial Sequence
  Description of Artificial Sequence: Synthetic oligonucleotide
agcattattccagtggatgggctgaaa

SEQ ID NO: 2550 - DNA, 27 bp, Artificial Sequence
  Description of Artificial Sequence: Synthetic oligonucleotide
gcattattccagtggatgggctgaaaa

SEQ ID NO: 2551 - DNA, 27 bp, Artificial Sequence
  Description of Artificial Sequence: Synthetic oligonucleotide
cattattccagtggatgggctgaaaaa

SEQ ID NO: 2552 - DNA, 27 bp, Artificial Sequence
  Description of Artificial Sequence: Synthetic oligonucleotide
attattccagtggatgggctgaaaaat

SEQ ID NO: 2553 - DNA, 27 bp, Artificial Sequence
  Description of Artificial Sequence: Synthetic oligonucleotide
ttattccagtggatgggctgaaaaatc

SEQ ID NO: 2554 - DNA, 27 bp, Artificial Sequence
  Description of Artificial Sequence: Synthetic oligonucleotide
tattccagtggatgggctgaaaaatca

SEQ ID NO: 2555 - DNA, 27 bp, Artificial Sequence
  Description of Artificial Sequence: Synthetic oligonucleotide
attccagtggatgggctgaaaaatcaa

SEQ ID NO: 2556 - DNA, 27 bp, Artificial Sequence
  Description of Artificial Sequence: Synthetic oligonucleotide
ttccagtggatgggctgaaaaatcaaa

SEQ ID NO: 2557 - DNA, 27 bp, Artificial Sequence
  Description of Artificial Sequence: Synthetic oligonucleotide
tccagtggatgggctgaaaaatcaaaa

SEQ ID NO: 2558 - DNA, 27 bp, Artificial Sequence
  Description of Artificial Sequence: Synthetic oligonucleotide
ccagtggatgggctgaaaaatcaaaaa

SEQ ID NO: 2559 - DNA, 27 bp, Artificial Sequence
  Description of Artificial Sequence: Synthetic oligonucleotide
cagtggatgggctgaaaaatcaaaaat

SEQ ID NO: 2560 - DNA, 27 bp, Artificial Sequence
  Description of Artificial Sequence: Synthetic oligonucleotide
agtggatgggctgaaaaatcaaaaatt

SEQ ID NO: 2561 - DNA, 27 bp, Artificial Sequence
  Description of Artificial Sequence: Synthetic oligonucleotide
gtggatgggctgaaaaatcaaaaattc

SEQ ID NO: 2562 - DNA, 27 bp, Artificial Sequence
  Description of Artificial Sequence: Synthetic oligonucleotide
tggatgggctgaaaaatcaaaaattct

SEQ ID NO: 2563 - DNA, 27 bp, Artificial Sequence
  Description of Artificial Sequence: Synthetic oligonucleotide
ggatgggctgaaaaatcaaaaattctt

SEQ ID NO: 2564 - DNA, 27 bp, Artificial Sequence
  Description of Artificial Sequence: Synthetic oligonucleotide
gatgggctgaaaaatcaaaaattcttt

SEQ ID NO: 2565 - DNA, 27 bp, Artificial Sequence
  Description of Artificial Sequence: Synthetic oligonucleotide
atgggctgaaaaatcaaaaattctttg

SEQ ID NO: 2566 - DNA, 27 bp, Artificial Sequence
  Description of Artificial Sequence: Synthetic oligonucleotide
tgggctgaaaaatcaaaaattctttga

SEQ ID NO: 2567 - DNA, 27 bp, Artificial Sequence
  Description of Artificial Sequence: Synthetic oligonucleotide
gggctgaaaaatcaaaaattctttgat

SEQ ID NO: 2568 - DNA, 27 bp, Artificial Sequence
  Description of Artificial Sequence: Synthetic oligonucleotide
ggctgaaaaatcaaaaattctttgatg

SEQ ID NO: 2569 - DNA, 27 bp, Artificial Sequence
  Description of Artificial Sequence: Synthetic oligonucleotide
gctgaaaaatcaaaaattctttgatga

SEQ ID NO: 2570 - DNA, 27 bp, Artificial Sequence
  Description of Artificial Sequence: Synthetic oligonucleotide
ctgaaaaatcaaaaattctttgatgaa

SEQ ID NO: 2571 - DNA, 27 bp, Artificial Sequence
  Description of Artificial Sequence: Synthetic oligonucleotide
tgaaaaatcaaaaattctttgatgaac

SEQ ID NO: 2572 - DNA, 27 bp, Artificial Sequence
  Description of Artificial Sequence: Synthetic oligonucleotide
aaaaatcaaaaattctttgatgaactt

SEQ ID NO: 2573 - DNA, 27 bp, Artificial Sequence
  Description of Artificial Sequence: Synthetic oligonucleotide
aaaatcaaaaattctttgatgaacttc

SEQ ID NO: 2574 - DNA, 27 bp, Artificial Sequence
  Description of Artificial Sequence: Synthetic oligonucleotide
aaatcaaaaattctttgatgaacttcg

SEQ ID NO: 2575 - DNA, 27 bp, Artificial Sequence
  Description of Artificial Sequence: Synthetic oligonucleotide
aatcaaaaattctttgatgaacttcga

SEQ ID NO: 2576 - DNA, 27 bp, Artificial Sequence
  Description of Artificial Sequence: Synthetic oligonucleotide
atcaaaaattctttgatgaacttcgaa

SEQ ID NO: 2577 - DNA, 27 bp, Artificial Sequence
  Description of Artificial Sequence: Synthetic oligonucleotide
tcaaaaattctttgatgaacttcgaat

SEQ ID NO: 2578 - DNA, 27 bp, Artificial Sequence
  Description of Artificial Sequence: Synthetic oligonucleotide
caaaaattctttgatgaacttcgaatg

SEQ ID NO: 2579 - DNA, 27 bp, Artificial Sequence
  Description of Artificial Sequence: Synthetic oligonucleotide
aaaaattctttgatgaacttcgaatga

SEQ ID NO: 2580 - DNA, 27 bp, Artificial Sequence
  Description of Artificial Sequence: Synthetic oligonucleotide
aaaattctttgatgaacttcgaatgaa

SEQ ID NO: 2581 - DNA, 27 bp, Artificial Sequence
  Description of Artificial Sequence: Synthetic oligonucleotide
aaattctttgatgaacttcgaatgaac

SEQ ID NO: 2582 - DNA, 27 bp, Artificial Sequence
  Description of Artificial Sequence: Synthetic oligonucleotide
aattctttgatgaacttcgaatgaact

SEQ ID NO: 2583 - DNA, 27 bp, Artificial Sequence
  Description of Artificial Sequence: Synthetic oligonucleotide
attctttgatgaacttcgaatgaacta

SEQ ID NO: 2584 - DNA, 27 bp, Artificial Sequence
  Description of Artificial Sequence: Synthetic oligonucleotide
ttctttgatgaacttcgaatgaactac

SEQ ID NO: 2585 - DNA, 27 bp, Artificial Sequence
  Description of Artificial Sequence: Synthetic oligonucleotide
tctttgatgaacttcgaatgaactaca

SEQ ID NO: 2586 - DNA, 27 bp, Artificial Sequence
  Description of Artificial Sequence: Synthetic oligonucleotide
ctttgatgaacttcgaatgaactacat

SEQ ID NO: 2587 - DNA, 27 bp, Artificial Sequence
  Description of Artificial Sequence: Synthetic oligonucleotide
tttgatgaacttcgaatgaactacatc

SEQ ID NO: 2588 - DNA, 27 bp, Artificial Sequence
  Description of Artificial Sequence: Synthetic oligonucleotide
ttgatgaacttcgaatgaactacatca

SEQ ID NO: 2589 - DNA, 27 bp, Artificial Sequence
  Description of Artificial Sequence: Synthetic oligonucleotide
tgatgaacttcgaatgaactacatcaa

SEQ ID NO: 2590 - DNA, 27 bp, Artificial Sequence
  Description of Artificial Sequence: Synthetic oligonucleotide
gatgaacttcgaatgaactacatcaag

SEQ ID NO: 2591 - DNA, 27 bp, Artificial Sequence
  Description of Artificial Sequence: Synthetic oligonucleotide
atgaacttcgaatgaactacatcaagg

SEQ ID NO: 2592 - DNA, 27 bp, Artificial Sequence
  Description of Artificial Sequence: Synthetic oligonucleotide
tgaacttcgaatgaactacatcaagga

SEQ ID NO: 2593 - DNA, 27 bp, Artificial Sequence
  Description of Artificial Sequence: Synthetic oligonucleotide
gaacttcgaatgaactacatcaaggaa

SEQ ID NO: 2594 - DNA, 27 bp, Artificial Sequence
  Description of Artificial Sequence: Synthetic oligonucleotide
aacttcgaatgaactacatcaaggaac

SEQ ID NO: 2595 - DNA, 27 bp, Artificial Sequence
  Description of Artificial Sequence: Synthetic oligonucleotide
acttcgaatgaactacatcaaggaact

SEQ ID NO: 2596 - DNA, 27 bp, Artificial Sequence
  Description of Artificial Sequence: Synthetic oligonucleotide
cttcgaatgaactacatcaaggaactc

SEQ ID NO: 2597 - DNA, 27 bp, Artificial Sequence
  Description of Artificial Sequence: Synthetic oligonucleotide
ttcgaatgaactacatcaaggaactcg

SEQ ID NO: 2598 - DNA, 27 bp, Artificial Sequence
  Description of Artificial Sequence: Synthetic oligonucleotide
tcgaatgaactacatcaaggaactcga

SEQ ID NO: 2599 - DNA, 27 bp, Artificial Sequence
  Description of Artificial Sequence: Synthetic oligonucleotide
cgaatgaactacatcaaggaactcgat

SEQ ID NO: 2600 - DNA, 27 bp, Artificial Sequence
  Description of Artificial Sequence: Synthetic oligonucleotide
gaatgaactacatcaaggaactcgatc

SEQ ID NO: 2601 - DNA, 27 bp, Artificial Sequence
  Description of Artificial Sequence: Synthetic oligonucleotide
aatgaactacatcaaggaactcgatcg

SEQ ID NO: 2602 - DNA, 27 bp, Artificial Sequence
  Description of Artificial Sequence: Synthetic oligonucleotide
atgaactacatcaaggaactcgatcgt

SEQ ID NO: 2603 - DNA, 27 bp, Artificial Sequence
  Description of Artificial Sequence: Synthetic oligonucleotide
tgaactacatcaaggaactcgatcgta

SEQ ID NO: 2604 - DNA, 27 bp, Artificial Sequence
  Description of Artificial Sequence: Synthetic oligonucleotide
gaactacatcaaggaactcgatcgtat

SEQ ID NO: 2605 - DNA, 27 bp, Artificial Sequence
  Description of Artificial Sequence: Synthetic oligonucleotide
aactacatcaaggaactcgatcgtatc

SEQ ID NO: 2606 - DNA, 27 bp, Artificial Sequence
  Description of Artificial Sequence: Synthetic oligonucleotide
actacatcaaggaactcgatcgtatca

SEQ ID NO: 2607 - DNA, 27 bp, Artificial Sequence
  Description of Artificial Sequence: Synthetic oligonucleotide
ctacatcaaggaactcgatcgtatcat

SEQ ID NO: 2608 - DNA, 27 bp, Artificial Sequence
  Description of Artificial Sequence: Synthetic oligonucleotide
gtatcattgcatgcaaaagaaaaaatc

SEQ ID NO: 2609 - DNA, 27 bp, Artificial Sequence
  Description of Artificial Sequence: Synthetic oligonucleotide
tatcattgcatgcaaaagaaaaaatcc

SEQ ID NO: 2610 - DNA, 27 bp, Artificial Sequence
  Description of Artificial Sequence: Synthetic oligonucleotide
aaaatcccacatcctgctcaagacgct

SEQ ID NO: 2611 - DNA, 27 bp, Artificial Sequence
  Description of Artificial Sequence: Synthetic oligonucleotide
aaatcccacatcctgctcaagacgctt

SEQ ID NO: 2612 - DNA, 27 bp, Artificial Sequence
  Description of Artificial Sequence: Synthetic oligonucleotide
gacgcttctaccagctcaccaagctcc

SEQ ID NO: 2613 - DNA, 27 bp, Artificial Sequence
  Description of Artificial Sequence: Synthetic oligonucleotide
acgcttctaccagctcaccaagctcct

SEQ ID NO: 2614 - DNA, 27 bp, Artificial Sequence
  Description of Artificial Sequence: Synthetic oligonucleotide
cgcttctaccagctcaccaagctcctg

SEQ ID NO: 2615 - DNA, 27 bp, Artificial Sequence
  Description of Artificial Sequence: Synthetic oligonucleotide
gcttctaccagctcaccaagctcctgg

SEQ ID NO: 2616 - DNA, 27 bp, Artificial Sequence
  Description of Artificial Sequence: Synthetic oligonucleotide
cttctaccagctcaccaagctcctgga

SEQ ID NO: 2617 - DNA, 27 bp, Artificial Sequence
  Description of Artificial Sequence: Synthetic oligonucleotide
ttctaccagctcaccaagctcctggac

SEQ ID NO: 2618 - DNA, 27 bp, Artificial Sequence
  Description of Artificial Sequence: Synthetic oligonucleotide
tctaccagctcaccaagctcctggact

SEQ ID NO: 2619 - DNA, 27 bp, Artificial Sequence
  Description of Artificial Sequence: Synthetic oligonucleotide
ctaccagctcaccaagctcctggactc

SEQ ID NO: 2620 - DNA, 27 bp, Artificial Sequence
  Description of Artificial Sequence: Synthetic oligonucleotide
taccagctcaccaagctcctggactcc

SEQ ID NO: 2621 - DNA, 27 bp, Artificial Sequence
  Description of Artificial Sequence: Synthetic oligonucleotide
accagctcaccaagctcctggactccg

SEQ ID NO: 2622 - DNA, 27 bp, Artificial Sequence
  Description of Artificial Sequence: Synthetic oligonucleotide
ccagctcaccaagctcctggactccgt

SEQ ID NO: 2623 - DNA, 27 bp, Artificial Sequence
  Description of Artificial Sequence: Synthetic oligonucleotide
agctcaccaagctcctggactccgtgc

SEQ ID NO: 2624 - DNA, 27 bp, Artificial Sequence
  Description of Artificial Sequence: Synthetic oligonucleotide
agctcctggactccgtgcagcctattg

SEQ ID NO: 2625 - DNA, 27 bp, Artificial Sequence
  Description of Artificial Sequence: Synthetic oligonucleotide
tccgtgcagcctattgcgagagagctg

SEQ ID NO: 2626 - DNA, 27 bp, Artificial Sequence
  Description of Artificial Sequence: Synthetic oligonucleotide
cgagagagctgcatcagttcacttttg

SEQ ID NO: 2627 - DNA, 27 bp, Artificial Sequence
  Description of Artificial Sequence: Synthetic oligonucleotide
gagagagctgcatcagttcacttttga

SEQ ID NO: 2628 - DNA, 27 bp, Artificial Sequence
  Description of Artificial Sequence: Synthetic oligonucleotide
agagagctgcatcagttcacttttgac

SEQ ID NO: 2629 - DNA, 27 bp, Artificial Sequence
  Description of Artificial Sequence: Synthetic oligonucleotide
gagagctgcatcagttcacttttgacc

SEQ ID NO: 2630 - DNA, 27 bp, Artificial Sequence
  Description of Artificial Sequence: Synthetic oligonucleotide
agagctgcatcagttcacttttgacct

SEQ ID NO: 2631 - DNA, 27 bp, Artificial Sequence
  Description of Artificial Sequence: Synthetic oligonucleotide
gagctgcatcagttcacttttgacctg

SEQ ID NO: 2632 - DNA, 27 bp, Artificial Sequence
  Description of Artificial Sequence: Synthetic oligonucleotide
agctgcatcagttcacttttgacctgc

SEQ ID NO: 2633 - DNA, 27 bp, Artificial Sequence
  Description of Artificial Sequence: Synthetic oligonucleotide
gctgcatcagttcacttttgacctgct

SEQ ID NO: 2634 - DNA, 27 bp, Artificial Sequence
  Description of Artificial Sequence: Synthetic oligonucleotide
ctgcatcagttcacttttgacctgcta

SEQ ID NO: 2635 - DNA, 27 bp, Artificial Sequence
  Description of Artificial Sequence: Synthetic oligonucleotide
tgcatcagttcacttttgacctgctaa

SEQ ID NO: 2636 - DNA, 27 bp, Artificial Sequence
  Description of Artificial Sequence: Synthetic oligonucleotide
gcatcagttcacttttgacctgctaat

SEQ ID NO: 2637 - DNA, 27 bp, Artificial Sequence
  Description of Artificial Sequence: Synthetic oligonucleotide
catcagttcacttttgacctgctaatc

SEQ ID NO: 2638 - DNA, 27 bp, Artificial Sequence
  Description of Artificial Sequence: Synthetic oligonucleotide
atcagttcacttttgacctgctaatca

SEQ ID NO: 2639 - DNA, 27 bp, Artificial Sequence
  Description of Artificial Sequence: Synthetic oligonucleotide
tcagttcacttttgacctgctaatcaa

SEQ ID NO: 2640 - DNA, 27 bp, Artificial Sequence
  Description of Artificial Sequence: Synthetic oligonucleotide
cagttcacttttgacctgctaatcaag

SEQ ID NO: 2641 - DNA, 27 bp, Artificial Sequence
  Description of Artificial Sequence: Synthetic oligonucleotide
agttcacttttgacctgctaatcaagt

SEQ ID NO: 2642 - DNA, 27 bp, Artificial Sequence
  Description of Artificial Sequence: Synthetic oligonucleotide
gttcacttttgacctgctaatcaagtc

SEQ ID NO: 2643 - DNA, 27 bp, Artificial Sequence
  Description of Artificial Sequence: Synthetic oligonucleotide
ttcacttttgacctgctaatcaagtca

SEQ ID NO: 2644 - DNA, 27 bp, Artificial Sequence
  Description of Artificial Sequence: Synthetic oligonucleotide
tcacttttgacctgctaatcaagtcac

SEQ ID NO: 2645 - DNA, 27 bp, Artificial Sequence
  Description of Artificial Sequence: Synthetic oligonucleotide
cacttttgacctgctaatcaagtcaca

SEQ ID NO: 2646 - DNA, 27 bp, Artificial Sequence
  Description of Artificial Sequence: Synthetic oligonucleotide
acttttgacctgctaatcaagtcacac

SEQ ID NO: 2647 - DNA, 27 bp, Artificial Sequence
  Description of Artificial Sequence: Synthetic oligonucleotide
acatggtgagcgtggactttccggaaa

SEQ ID NO: 2648 - DNA, 27 bp, Artificial Sequence
  Description of Artificial Sequence: Synthetic oligonucleotide
catggtgagcgtggactttccggaaat

SEQ ID NO: 2649 - DNA, 27 bp, Artificial Sequence
  Description of Artificial Sequence: Synthetic oligonucleotide
cggaaatgatggcagagatcatctctg

SEQ ID NO: 2650 - DNA, 27 bp, Artificial Sequence
  Description of Artificial Sequence: Synthetic oligonucleotide
ggaaatgatggcagagatcatctctgt

SEQ ID NO: 2651 - DNA, 27 bp, Artificial Sequence
  Description of Artificial Sequence: Synthetic oligonucleotide
gaaatgatggcagagatcatctctgtg

SEQ ID NO: 2652 - DNA, 27 bp, Artificial Sequence
  Description of Artificial Sequence: Synthetic oligonucleotide
aaatgatggcagagatcatctctgtgc

SEQ ID NO: 2653 - DNA, 27 bp, Artificial Sequence
  Description of Artificial Sequence: Synthetic oligonucleotide
aatgatggcagagatcatctctgtgca

SEQ ID NO: 2654 - DNA, 27 bp, Artificial Sequence
  Description of Artificial Sequence: Synthetic oligonucleotide
atgatggcagagatcatctctgtgcaa

SEQ ID NO: 2655 - DNA, 27 bp, Artificial Sequence
  Description of Artificial Sequence: Synthetic oligonucleotide
tgatggcagagatcatctctgtgcaag

SEQ ID NO: 2656 - DNA, 27 bp, Artificial Sequence
  Description of Artificial Sequence: Synthetic oligonucleotide
gatggcagagatcatctctgtgcaagt

SEQ ID NO: 2657 - DNA, 27 bp, Artificial Sequence
  Description of Artificial Sequence: Synthetic oligonucleotide
atggcagagatcatctctgtgcaagtg

SEQ ID NO: 2658 - DNA, 27 bp, Artificial Sequence
  Description of Artificial Sequence: Synthetic oligonucleotide
tggcagagatcatctctgtgcaagtgc

SEQ ID NO: 2659 - DNA, 27 bp, Artificial Sequence
  Description of Artificial Sequence: Synthetic oligonucleotide
ggcagagatcatctctgtgcaagtgcc

SEQ ID NO: 2660 - DNA, 27 bp, Artificial Sequence
  Description of Artificial Sequence: Synthetic oligonucleotide
gcagagatcatctctgtgcaagtgccc

SEQ ID NO: 2661 - DNA, 27 bp, Artificial Sequence
  Description of Artificial Sequence: Synthetic oligonucleotide
cagagatcatctctgtgcaagtgccca

SEQ ID NO: 2662 - DNA, 27 bp, Artificial Sequence
  Description of Artificial Sequence: Synthetic oligonucleotide
agagatcatctctgtgcaagtgcccaa

SEQ ID NO: 2663 - DNA, 27 bp, Artificial Sequence
  Description of Artificial Sequence: Synthetic oligonucleotide
gagatcatctctgtgcaagtgcccaag

SEQ ID NO: 2664 - DNA, 27 bp, Artificial Sequence
  Description of Artificial Sequence: Synthetic oligonucleotide
agatcatctctgtgcaagtgcccaaga

SEQ ID NO: 2665 - DNA, 27 bp, Artificial Sequence
  Description of Artificial Sequence: Synthetic oligonucleotide
gatcatctctgtgcaagtgcccaagat

SEQ ID NO: 2666 - DNA, 27 bp, Artificial Sequence
  Description of Artificial Sequence: Synthetic oligonucleotide
atcatctctgtgcaagtgcccaagatc

SEQ ID NO: 2667 - DNA, 27 bp, Artificial Sequence
  Description of Artificial Sequence: Synthetic oligonucleotide
tcatctctgtgcaagtgcccaagatcc

SEQ ID NO: 2668 - DNA, 27 bp, Artificial Sequence
  Description of Artificial Sequence: Synthetic oligonucleotide
catctctgtgcaagtgcccaagatcct

SEQ ID NO: 2669 - DNA, 27 bp, Artificial Sequence
  Description of Artificial Sequence: Synthetic oligonucleotide
atctctgtgcaagtgcccaagatcctt

SEQ ID NO: 2670 - DNA, 27 bp, Artificial Sequence
  Description of Artificial Sequence: Synthetic oligonucleotide
tctctgtgcaagtgcccaagatccttt

SEQ ID NO: 2671 - DNA, 27 bp, Artificial Sequence
  Description of Artificial Sequence: Synthetic oligonucleotide
ctctgtgcaagtgcccaagatcctttc

SEQ ID NO: 2672 - DNA, 27 bp, Artificial Sequence
  Description of Artificial Sequence: Synthetic oligonucleotide
tctgtgcaagtgcccaagatcctttct

SEQ ID NO: 2673 - DNA, 27 bp, Artificial Sequence
  Description of Artificial Sequence: Synthetic oligonucleotide
ctgtgcaagtgcccaagatcctttctg

SEQ ID NO: 2674 - DNA, 27 bp, Artificial Sequence
  Description of Artificial Sequence: Synthetic oligonucleotide
tgtgcaagtgcccaagatcctttctgg

SEQ ID NO: 2675 - DNA, 27 bp, Artificial Sequence
  Description of Artificial Sequence: Synthetic oligonucleotide
gtgcaagtgcccaagatcctttctggg

SEQ ID NO: 2676 - DNA, 27 bp, Artificial Sequence
  Description of Artificial Sequence: Synthetic oligonucleotide
tgcaagtgcccaagatcctttctggga

SEQ ID NO: 2677 - DNA, 27 bp, Artificial Sequence
  Description of Artificial Sequence: Synthetic oligonucleotide
gcaagtgcccaagatcctttctgggaa

SEQ ID NO: 2678 - DNA, 27 bp, Artificial Sequence
  Description of Artificial Sequence: Synthetic oligonucleotide
caagtgcccaagatcctttctgggaaa

SEQ ID NO: 2679 - DNA, 27 bp, Artificial Sequence
  Description of Artificial Sequence: Synthetic oligonucleotide
aagtgcccaagatcctttctgggaaag

SEQ ID NO: 2680 - DNA, 27 bp, Artificial Sequence
  Description of Artificial Sequence: Synthetic oligonucleotide
agtgcccaagatcctttctgggaaagt

SEQ ID NO: 2681 - DNA, 27 bp, Artificial Sequence
  Description of Artificial Sequence: Synthetic oligonucleotide
gtgcccaagatcctttctgggaaagtc

SEQ ID NO: 2682 - DNA, 27 bp, Artificial Sequence
  Description of Artificial Sequence: Synthetic oligonucleotide
tgcccaagatcctttctgggaaagtca

SEQ ID NO: 2683 - DNA, 27 bp, Artificial Sequence
  Description of Artificial Sequence: Synthetic oligonucleotide
gcccaagatcctttctgggaaagtcaa

SEQ ID NO: 2684 - DNA, 27 bp, Artificial Sequence
  Description of Artificial Sequence: Synthetic oligonucleotide
cccaagatcctttctgggaaagtcaag

SEQ ID NO: 2685 - DNA, 27 bp, Artificial Sequence
  Description of Artificial Sequence: Synthetic oligonucleotide
ccaagatcctttctgggaaagtcaagc

SEQ ID NO: 2686 - DNA, 27 bp, Artificial Sequence
  Description of Artificial Sequence: Synthetic oligonucleotide
caagatcctttctgggaaagtcaagcc

SEQ ID NO: 2687 - DNA, 27 bp, Artificial Sequence
  Description of Artificial Sequence: Synthetic oligonucleotide
aagatcctttctgggaaagtcaagccc

SEQ ID NO: 2688 - DNA, 27 bp, Artificial Sequence
  Description of Artificial Sequence: Synthetic oligonucleotide
agatcctttctgggaaagtcaagccca

SEQ ID NO: 2689 - DNA, 27 bp, Artificial Sequence
  Description of Artificial Sequence: Synthetic oligonucleotide
gatcctttctgggaaagtcaagcccat

SEQ ID NO: 2690 - DNA, 27 bp, Artificial Sequence
  Description of Artificial Sequence: Synthetic oligonucleotide
atcctttctgggaaagtcaagcccatc

SEQ ID NO: 2691 - DNA, 27 bp, Artificial Sequence
  Description of Artificial Sequence: Synthetic oligonucleotide
tcctttctgggaaagtcaagcccatct

SEQ ID NO: 2692 - DNA, 27 bp, Artificial Sequence
  Description of Artificial Sequence: Synthetic oligonucleotide
cctttctgggaaagtcaagcccatcta

SEQ ID NO: 2693 - DNA, 27 bp, Artificial Sequence
  Description of Artificial Sequence: Synthetic oligonucleotide
ctttctgggaaagtcaagcccatctat

SEQ ID NO: 2694 - DNA, 27 bp, Artificial Sequence
  Description of Artificial Sequence: Synthetic oligonucleotide
tttctgggaaagtcaagcccatctatt

SEQ ID NO: 2695 - DNA, 27 bp, Artificial Sequence
  Description of Artificial Sequence: Synthetic oligonucleotide
ttctgggaaagtcaagcccatctattt

SEQ ID NO: 2696 - DNA, 27 bp, Artificial Sequence
  Description of Artificial Sequence: Synthetic oligonucleotide
tctgggaaagtcaagcccatctatttc

SEQ ID NO: 2697 - DNA, 27 bp, Artificial Sequence
  Description of Artificial Sequence: Synthetic oligonucleotide
ctgggaaagtcaagcccatctatttcc

SEQ ID NO: 2698 - DNA, 27 bp, Artificial Sequence
  Description of Artificial Sequence: Synthetic oligonucleotide
tgggaaagtcaagcccatctatttcca

SEQ ID NO: 2699 - DNA, 27 bp, Artificial Sequence
  Description of Artificial Sequence: Synthetic oligonucleotide
gggaaagtcaagcccatctatttccac

SEQ ID NO: 2700 - DNA, 27 bp, Artificial Sequence
  Description of Artificial Sequence: Synthetic oligonucleotide
ggaaagtcaagcccatctatttccaca

SEQ ID NO: 2701 - DNA, 27 bp, Artificial Sequence
  Description of Artificial Sequence: Synthetic oligonucleotide
gaaagtcaagcccatctatttccacac

SEQ ID NO: 2702 - DNA, 27 bp, Artificial Sequence
  Description of Artificial Sequence: Synthetic oligonucleotide
ttcagatgtcttctgcctgttataact

SEQ ID NO: 2703 - DNA, 27 bp, Artificial Sequence
  Description of Artificial Sequence: Synthetic oligonucleotide
tcagatgtcttctgcctgttataactc

SEQ ID NO: 2704 - DNA, 27 bp, Artificial Sequence
  Description of Artificial Sequence: Synthetic oligonucleotide
cagatgtcttctgcctgttataactct

SEQ ID NO: 2705 - DNA, 27 bp, Artificial Sequence
  Description of Artificial Sequence: Synthetic oligonucleotide
agatgtcttctgcctgttataactctg

SEQ ID NO: 2706 - DNA, 27 bp, Artificial Sequence
  Description of Artificial Sequence: Synthetic oligonucleotide
ggggaatttcctctattgatgtacagt

SEQ ID NO: 2707 - DNA, 27 bp, Artificial Sequence
  Description of Artificial Sequence: Synthetic oligonucleotide
ttgctgggctttttttttctctttctc

SEQ ID NO: 2708 - DNA, 27 bp, Artificial Sequence
  Description of Artificial Sequence: Synthetic oligonucleotide
tgctgggctttttttttctctttctct

SEQ ID NO: 2709 - DNA, 27 bp, Artificial Sequence
  Description of Artificial Sequence: Synthetic oligonucleotide
gctttttttttctctttctctcctttc

SEQ ID NO: 2710 - DNA, 27 bp, Artificial Sequence
  Description of Artificial Sequence: Synthetic oligonucleotide
ttttttctctttctctcctttcttttt

SEQ ID NO: 2711 - DNA, 27 bp, Artificial Sequence
  Description of Artificial Sequence: Synthetic oligonucleotide
tctttttcttcttccctccctatctaa

SEQ ID NO: 2712 - DNA, 27 bp, Artificial Sequence
  Description of Artificial Sequence: Synthetic oligonucleotide
tgttgtatgcctttaaatctgtgatga

SEQ ID NO: 2713 - DNA, 27 bp, Artificial Sequence
  Description of Artificial Sequence: Synthetic oligonucleotide
tgtgcttgtttacagcactactctgtg

SEQ ID NO: 2714 - DNA, 27 bp, Artificial Sequence
  Description of Artificial Sequence: Synthetic oligonucleotide
ttagagagctaagattatctggggaaa

SEQ ID NO: 2715 - DNA, 27 bp, Artificial Sequence
  Description of Artificial Sequence: Synthetic oligonucleotide
ggggaaatcaaaacaaaaacaagcaaa

SEQ ID NO: 2716 - RNA, 25 nt, Artificial Sequence
  Description of Artificial Sequence: Synthetic oligonucleotide
gccagcuugcugggagagcgggacg

SEQ ID NO: 2717 - RNA, 25 nt, Artificial Sequence
  Description of Artificial Sequence: Synthetic oligonucleotide
gcuccagcgacagccaacgccucuu

SEQ ID NO: 2718 - RNA, 25 nt, Artificial Sequence
  Description of Artificial Sequence: Synthetic oligonucleotide
gccaacgccucuugcagcgcggcgg

SEQ ID NO: 2719 - RNA, 25 nt, Artificial Sequence
  Description of Artificial Sequence: Synthetic oligonucleotide
cucuugcagcgcggcggcuucgaag

SEQ ID NO: 2720 - RNA, 25 nt, Artificial Sequence
  Description of Artificial Sequence: Synthetic oligonucleotide
cagcgcggcggcuucgaagccgccg

SEQ ID NO: 2721 - RNA, 25 nt, Artificial Sequence
  Description of Artificial Sequence: Synthetic oligonucleotide
aagccgccgcccggagcugcccuuu

SEQ ID NO: 2722 - RNA, 25 nt, Artificial Sequence
  Description of Artificial Sequence: Synthetic oligonucleotide
ccgcccggagcugcccuuuccucuu

SEQ ID NO: 2723 - RNA, 25 nt, Artificial Sequence
  Description of Artificial Sequence: Synthetic oligonucleotide
aaguuuuuaaaagcugcuaaagacu

SEQ ID NO: 2724 - RNA, 25 nt, Artificial Sequence
  Description of Artificial Sequence: Synthetic oligonucleotide
gucuucucucccgcagcugccucag

SEQ ID NO: 2725 - RNA, 25 nt, Artificial Sequence
  Description of Artificial Sequence: Synthetic oligonucleotide
gcagcugccucagucggcuacucuc

SEQ ID NO: 2726 - RNA, 25 nt, Artificial Sequence
  Description of Artificial Sequence: Synthetic oligonucleotide
uggcugcgagcgggcgagcuagcug

SEQ ID NO: 2727 - RNA, 25 nt, Artificial Sequence
  Description of Artificial Sequence: Synthetic oligonucleotide
ggcgagcuagcugcacauugcaaag

SEQ ID NO: 2728 - RNA, 25 nt, Artificial Sequence
  Description of Artificial Sequence: Synthetic oligonucleotide
ucucuccaccuccuccugccuuccc

SEQ ID NO: 2729 - RNA, 25 nt, Artificial Sequence
  Description of Artificial Sequence: Synthetic oligonucleotide
agagaucaaaagaugaaaaggcagu

SEQ ID NO: 2730 - RNA, 25 nt, Artificial Sequence
  Description of Artificial Sequence: Synthetic oligonucleotide
guagccaaaaaacaaaacaaacaaa

SEQ ID NO: 2731 - RNA, 25 nt, Artificial Sequence
  Description of Artificial Sequence: Synthetic oligonucleotide
aaaaaacaaaacaaacaaaaacaaa

SEQ ID NO: 2732 - RNA, 25 nt, Artificial Sequence
  Description of Artificial Sequence: Synthetic oligonucleotide
aaaacaaacaaaaacaaaaaagccg

SEQ ID NO: 2733 - RNA, 25 nt, Artificial Sequence
  Description of Artificial Sequence: Synthetic oligonucleotide
aaaaaagccgaaauaaaagaaaaag

SEQ ID NO: 2734 - RNA, 25 nt, Artificial Sequence
  Description of Artificial Sequence: Synthetic oligonucleotide
cgaaauaaaagaaaaagauaauaac

SEQ ID NO: 2735 - RNA, 25 nt, Artificial Sequence
  Description of Artificial Sequence: Synthetic oligonucleotide
gaaaaagauaauaacucaguucuua

SEQ ID NO: 2736 - RNA, 25 nt, Artificial Sequence
  Description of Artificial Sequence: Synthetic oligonucleotide
agauaauaacucaguucuuauuugc

SEQ ID NO: 2737 - RNA, 25 nt, Artificial Sequence
  Description of Artificial Sequence: Synthetic oligonucleotide
uaauaacucaguucuuauuugcacc

SEQ ID NO: 2738 - RNA, 25 nt, Artificial Sequence
  Description of Artificial Sequence: Synthetic oligonucleotide
gaggauuuuguuuuuuucuuuuaag

SEQ ID NO: 2739 - RNA, 25 nt, Artificial Sequence
  Description of Artificial Sequence: Synthetic oligonucleotide
uuuuguuuuuuucuuuuaagaucug

SEQ ID NO: 2740 - RNA, 25 nt, Artificial Sequence
  Description of Artificial Sequence: Synthetic oligonucleotide
uuuuuucuuuuaagaucugggcauc

SEQ ID NO: 2741 - RNA, 25 nt, Artificial Sequence
  Description of Artificial Sequence: Synthetic oligonucleotide
gcaucuuuugaaucuacccuucaag

SEQ ID NO: 2742 - RNA, 25 nt, Artificial Sequence
  Description of Artificial Sequence: Synthetic oligonucleotide
gagcgcuuuuugcgugguugcuccc

SEQ ID NO: 2743 - RNA, 25 nt, Artificial Sequence
  Description of Artificial Sequence: Synthetic oligonucleotide
cuuuuugcgugguugcucccgcaag

SEQ ID NO: 2744 - RNA, 25 nt, Artificial Sequence
  Description of Artificial Sequence: Synthetic oligonucleotide
guuuccuucucuggagcuucccgca

SEQ ID NO: 2745 - RNA, 25 nt, Artificial Sequence
  Description of Artificial Sequence: Synthetic oligonucleotide
cuucccgcaggugggcagcuagcug

SEQ ID NO: 2746 - RNA, 25 nt, Artificial Sequence
  Description of Artificial Sequence: Synthetic oligonucleotide
gggcagcuagcugcagcgacuaccg

SEQ ID NO: 2747 - RNA, 25 nt, Artificial Sequence
  Description of Artificial Sequence: Synthetic oligonucleotide
gugcaguuagggcugggaagggucu

SEQ ID NO: 2748 - RNA, 25 nt, Artificial Sequence
  Description of Artificial Sequence: Synthetic oligonucleotide
ugcaguuagggcugggaagggucua

SEQ ID NO: 2749 - RNA, 25 nt, Artificial Sequence
  Description of Artificial Sequence: Synthetic oligonucleotide
gcaguuagggcugggaagggucuac

SEQ ID NO: 2750 - RNA, 25 nt, Artificial Sequence
  Description of Artificial Sequence: Synthetic oligonucleotide
caguuagggcugggaagggucuacc

SEQ ID NO: 2751 - RNA, 25 nt, Artificial Sequence
  Description of Artificial Sequence: Synthetic oligonucleotide
aguuagggcugggaagggucuaccc

SEQ ID NO: 2752 - RNA, 25 nt, Artificial Sequence
  Description of Artificial Sequence: Synthetic oligonucleotide
guuagggcugggaagggucuacccu

SEQ ID NO: 2753 - RNA, 25 nt, Artificial Sequence
  Description of Artificial Sequence: Synthetic oligonucleotide
uuagggcugggaagggucuacccuc

SEQ ID NO: 2754 - RNA, 25 nt, Artificial Sequence
  Description of Artificial Sequence: Synthetic oligonucleotide
uagggcugggaagggucuacccucg

SEQ ID NO: 2755 - RNA, 25 nt, Artificial Sequence
  Description of Artificial Sequence: Synthetic oligonucleotide
agggcugggaagggucuacccucgg

SEQ ID NO: 2756 - RNA, 25 nt, Artificial Sequence
  Description of Artificial Sequence: Synthetic oligonucleotide
gggcugggaagggucuacccucggc

SEQ ID NO: 2757 - RNA, 25 nt, Artificial Sequence
  Description of Artificial Sequence: Synthetic oligonucleotide
ggcugggaagggucuacccucggcc

SEQ ID NO: 2758 - RNA, 25 nt, Artificial Sequence
  Description of Artificial Sequence: Synthetic oligonucleotide
uuccagaaucuguuccagagcgugc

SEQ ID NO: 2759 - RNA, 25 nt, Artificial Sequence
  Description of Artificial Sequence: Synthetic oligonucleotide
uccagaaucuguuccagagcgugcg

SEQ ID NO: 2760 - RNA, 25 nt, Artificial Sequence
  Description of Artificial Sequence: Synthetic oligonucleotide
ccagaaucuguuccagagcgugcgc

SEQ ID NO: 2761 - RNA, 25 nt, Artificial Sequence
  Description of Artificial Sequence: Synthetic oligonucleotide
cagaaucuguuccagagcgugcgcg

SEQ ID NO: 2762 - RNA, 25 nt, Artificial Sequence
  Description of Artificial Sequence: Synthetic oligonucleotide
agaaucuguuccagagcgugcgcga

SEQ ID NO: 2763 - RNA, 25 nt, Artificial Sequence
  Description of Artificial Sequence: Synthetic oligonucleotide
gaaucuguuccagagcgugcgcgaa

SEQ ID NO: 2764 - RNA, 25 nt, Artificial Sequence
  Description of Artificial Sequence: Synthetic oligonucleotide
aaucuguuccagagcgugcgcgaag

SEQ ID NO: 2765 - RNA, 25 nt, Artificial Sequence
  Description of Artificial Sequence: Synthetic oligonucleotide
aucuguuccagagcgugcgcgaagu

SEQ ID NO: 2766 - RNA, 25 nt, Artificial Sequence
  Description of Artificial Sequence: Synthetic oligonucleotide
ucuguuccagagcgugcgcgaagug

SEQ ID NO: 2767 - RNA, 25 nt, Artificial Sequence
  Description of Artificial Sequence: Synthetic oligonucleotide
cuguuccagagcgugcgcgaaguga

SEQ ID NO: 2768 - RNA, 25 nt, Artificial Sequence
  Description of Artificial Sequence: Synthetic oligonucleotide
uguuccagagcgugcgcgaagugau

SEQ ID NO: 2769 - RNA, 25 nt, Artificial Sequence
  Description of Artificial Sequence: Synthetic oligonucleotide
guuccagagcgugcgcgaagugauc

SEQ ID NO: 2770 - RNA, 25 nt, Artificial Sequence
  Description of Artificial Sequence: Synthetic oligonucleotide
uuccagagcgugcgcgaagugaucc

SEQ ID NO: 2771 - RNA, 25 nt, Artificial Sequence
  Description of Artificial Sequence: Synthetic oligonucleotide
cgccaguuugcugcugcugcagcag

SEQ ID NO: 2772 - RNA, 25 nt, Artificial Sequence
  Description of Artificial Sequence: Synthetic oligonucleotide
gcugcugcugcagcagcagcagcag

SEQ ID NO: 2773 - RNA, 25 nt, Artificial Sequence
  Description of Artificial Sequence: Synthetic oligonucleotide
gucccagagccuggagccgccgugg

SEQ ID NO: 2774 - RNA, 25 nt, Artificial Sequence
  Description of Artificial Sequence: Synthetic oligonucleotide
cugccgcagcagcugccagcaccuc

SEQ ID NO: 2775 - RNA, 25 nt, Artificial Sequence
  Description of Artificial Sequence: Synthetic oligonucleotide
cagcagcugccagcaccuccggacg

SEQ ID NO: 2776 - RNA, 25 nt, Artificial Sequence
  Description of Artificial Sequence: Synthetic oligonucleotide
cauccacguugucccugcugggccc

SEQ ID NO: 2777 - RNA, 25 nt, Artificial Sequence
  Description of Artificial Sequence: Synthetic oligonucleotide
ggcuuaagcagcugcuccgcugacc

SEQ ID NO: 2778 - RNA, 25 nt, Artificial Sequence
  Description of Artificial Sequence: Synthetic oligonucleotide
gcuuaagcagcugcuccgcugaccu

SEQ ID NO: 2779 - RNA, 25 nt, Artificial Sequence
  Description of Artificial Sequence: Synthetic oligonucleotide
agcagcugcuccgcugaccuuaaag

SEQ ID NO: 2780 - RNA, 25 nt, Artificial Sequence
  Description of Artificial Sequence: Synthetic oligonucleotide
gcaacuccuucagcaacagcagcag

SEQ ID NO: 2781 - RNA, 25 nt, Artificial Sequence
  Description of Artificial Sequence: Synthetic oligonucleotide
cauuucugacaacgccaaggaguug

SEQ ID NO: 2782 - RNA, 25 nt, Artificial Sequence
  Description of Artificial Sequence: Synthetic oligonucleotide
acuuuugggaguuccacccgcugug

SEQ ID NO: 2783 - RNA, 25 nt, Artificial Sequence
  Description of Artificial Sequence: Synthetic oligonucleotide
ggcaagagcacugaagauacugcug

SEQ ID NO: 2784 - RNA, 25 nt, Artificial Sequence
  Description of Artificial Sequence: Synthetic oligonucleotide
ggcagcgcugcagcagggagcuccg

SEQ ID NO: 2785 - RNA, 25 nt, Artificial Sequence
  Description of Artificial Sequence: Synthetic oligonucleotide
ucgcgacuacuacaacuuuccacug

SEQ ID NO: 2786 - RNA, 25 nt, Artificial Sequence
  Description of Artificial Sequence: Synthetic oligonucleotide
cgcgacuacuacaacuuuccacugg

SEQ ID NO: 2787 - RNA, 25 nt, Artificial Sequence
  Description of Artificial Sequence: Synthetic oligonucleotide
gcgacuacuacaacuuuccacuggc

SEQ ID NO: 2788 - RNA, 25 nt, Artificial Sequence
  Description of Artificial Sequence: Synthetic oligonucleotide
ucgcaucaagcuggagaacccgcug

SEQ ID NO: 2789 - RNA, 25 nt, Artificial Sequence
  Description of Artificial Sequence: Synthetic oligonucleotide
uggacuacggcagcgccugggcggc

SEQ ID NO: 2790 - RNA, 25 nt, Artificial Sequence
  Description of Artificial Sequence: Synthetic oligonucleotide
ggacuacggcagcgccugggcggcu

SEQ ID NO: 2791 - RNA, 25 nt, Artificial Sequence
  Description of Artificial Sequence: Synthetic oligonucleotide
gacuacggcagcgccugggcggcug

SEQ ID NO: 2792 - RNA, 25 nt, Artificial Sequence
  Description of Artificial Sequence: Synthetic oligonucleotide
acuacggcagcgccugggcggcugc

SEQ ID NO: 2793 - RNA, 25 nt, Artificial Sequence
  Description of Artificial Sequence: Synthetic oligonucleotide
gcgcgggugcagcgggacccgguuc

SEQ ID NO: 2794 - RNA, 25 nt, Artificial Sequence
  Description of Artificial Sequence: Synthetic oligonucleotide
cuggcgggccaggaaagcgacuuca

SEQ ID NO: 2795 - RNA, 25 nt, Artificial Sequence
  Description of Artificial Sequence: Synthetic oligonucleotide
acccuggcggcauggugagcagagu

SEQ ID NO: 2796 - RNA, 25 nt, Artificial Sequence
  Description of Artificial Sequence: Synthetic oligonucleotide
gauggauagcuacuccggaccuuac

SEQ ID NO: 2797 - RNA, 25 nt, Artificial Sequence
  Description of Artificial Sequence: Synthetic oligonucleotide
cagaagaccugccugaucuguggag

SEQ ID NO: 2798 - RNA, 25 nt, Artificial Sequence
  Description of Artificial Sequence: Synthetic oligonucleotide
agaagaccugccugaucuguggaga

SEQ ID NO: 2799 - RNA, 25 nt, Artificial Sequence
  Description of Artificial Sequence: Synthetic oligonucleotide
gaagaccugccugaucuguggagau

SEQ ID NO: 2800 - RNA, 25 nt, Artificial Sequence
  Description of Artificial Sequence: Synthetic oligonucleotide
aagaccugccugaucuguggagaug

SEQ ID NO: 2801 - RNA, 25 nt, Artificial Sequence
  Description of Artificial Sequence: Synthetic oligonucleotide
agaccugccugaucuguggagauga

SEQ ID NO: 2802 - RNA, 25 nt, Artificial Sequence
  Description of Artificial Sequence: Synthetic oligonucleotide
gaccugccugaucuguggagaugaa

SEQ ID NO: 2803 - RNA, 25 nt, Artificial Sequence
  Description of Artificial Sequence: Synthetic oligonucleotide
accugccugaucuguggagaugaag

SEQ ID NO: 2804 - RNA, 25 nt, Artificial Sequence
  Description of Artificial Sequence: Synthetic oligonucleotide
ccugccugaucuguggagaugaagc

SEQ ID NO: 2805 - RNA, 25 nt, Artificial Sequence
  Description of Artificial Sequence: Synthetic oligonucleotide
cugccugaucuguggagaugaagcu

SEQ ID NO: 2806 - RNA, 25 nt, Artificial Sequence
  Description of Artificial Sequence: Synthetic oligonucleotide
ugccugaucuguggagaugaagcuu

SEQ ID NO: 2807 - RNA, 25 nt, Artificial Sequence
  Description of Artificial Sequence: Synthetic oligonucleotide
gccugaucuguggagaugaagcuuc

SEQ ID NO: 2808 - RNA, 25 nt, Artificial Sequence
  Description of Artificial Sequence: Synthetic oligonucleotide
ccugaucuguggagaugaagcuucu

SEQ ID NO: 2809 - RNA, 25 nt, Artificial Sequence
  Description of Artificial Sequence: Synthetic oligonucleotide
cugaucuguggagaugaagcuucug

SEQ ID NO: 2810 - RNA, 25 nt, Artificial Sequence
  Description of Artificial Sequence: Synthetic oligonucleotide
ugaucuguggagaugaagcuucugg

SEQ ID NO: 2811 - RNA, 25 nt, Artificial Sequence
  Description of Artificial Sequence: Synthetic oligonucleotide
gaucuguggagaugaagcuucuggg

SEQ ID NO: 2812 - RNA, 25 nt, Artificial Sequence
  Description of Artificial Sequence: Synthetic oligonucleotide
aucuguggagaugaagcuucugggu

SEQ ID NO: 2813 - RNA, 25 nt, Artificial Sequence
  Description of Artificial Sequence: Synthetic oligonucleotide
ucuguggagaugaagcuucugggug

SEQ ID NO: 2814 - RNA, 25 nt, Artificial Sequence
  Description of Artificial Sequence: Synthetic oligonucleotide
cuguggagaugaagcuucugggugu

SEQ ID NO: 2815 - RNA, 25 nt, Artificial Sequence
  Description of Artificial Sequence: Synthetic oligonucleotide
uguggagaugaagcuucuggguguc

SEQ ID NO: 2816 - RNA, 25 nt, Artificial Sequence
  Description of Artificial Sequence: Synthetic oligonucleotide
guggagaugaagcuucuggguguca

SEQ ID NO: 2817 - RNA, 25 nt, Artificial Sequence
  Description of Artificial Sequence: Synthetic oligonucleotide
uucugggugucacuauggagcucuc

SEQ ID NO: 2818 - RNA, 25 nt, Artificial Sequence
  Description of Artificial Sequence: Synthetic oligonucleotide
gagcucucacauguggaagcugcaa

SEQ ID NO: 2819 - RNA, 25 nt, Artificial Sequence
  Description of Artificial Sequence: Synthetic oligonucleotide
agcugcaaggucuucuucaaaagag

SEQ ID NO: 2820 - RNA, 25 nt, Artificial Sequence
  Description of Artificial Sequence: Synthetic oligonucleotide
gcugcaaggucuucuucaaaagagc

SEQ ID NO: 2821 - RNA, 25 nt, Artificial Sequence
  Description of Artificial Sequence: Synthetic oligonucleotide
cugcaaggucuucuucaaaagagcc

SEQ ID NO: 2822 - RNA, 25 nt, Artificial Sequence
  Description of Artificial Sequence: Synthetic oligonucleotide
ugcaaggucuucuucaaaagagccg

SEQ ID NO: 2823 - RNA, 25 nt, Artificial Sequence
  Description of Artificial Sequence: Synthetic oligonucleotide
gcaaggucuucuucaaaagagccgc

SEQ ID NO: 2824 - RNA, 25 nt, Artificial Sequence
  Description of Artificial Sequence: Synthetic oligonucleotide
caaggucuucuucaaaagagccgcu

SEQ ID NO: 2825 - RNA, 25 nt, Artificial Sequence
  Description of Artificial Sequence: Synthetic oligonucleotide
aaggucuucuucaaaagagccgcug

SEQ ID NO: 2826 - RNA, 25 nt, Artificial Sequence
  Description of Artificial Sequence: Synthetic oligonucleotide
aggucuucuucaaaagagccgcuga

SEQ ID NO: 2827 - RNA, 25 nt, Artificial Sequence
  Description of Artificial Sequence: Synthetic oligonucleotide
ggucuucuucaaaagagccgcugaa

SEQ ID NO: 2828 - RNA, 25 nt, Artificial Sequence
  Description of Artificial Sequence: Synthetic oligonucleotide
gucuucuucaaaagagccgcugaag

SEQ ID NO: 2829 - RNA, 25 nt, Artificial Sequence
  Description of Artificial Sequence: Synthetic oligonucleotide
ucuucuucaaaagagccgcugaagg

SEQ ID NO: 2830 - RNA, 25 nt, Artificial Sequence
  Description of Artificial Sequence: Synthetic oligonucleotide
cuucuucaaaagagccgcugaaggg

SEQ ID NO: 2831 - RNA, 25 nt, Artificial Sequence
  Description of Artificial Sequence: Synthetic oligonucleotide
uucuucaaaagagccgcugaaggga

SEQ ID NO: 2832 - RNA, 25 nt, Artificial Sequence
  Description of Artificial Sequence: Synthetic oligonucleotide
ucuucaaaagagccgcugaagggaa

SEQ ID NO: 2833 - RNA, 25 nt, Artificial Sequence
  Description of Artificial Sequence: Synthetic oligonucleotide
cuucaaaagagccgcugaagggaaa

SEQ ID NO: 2834 - RNA, 25 nt, Artificial Sequence
  Description of Artificial Sequence: Synthetic oligonucleotide
uucaaaagagccgcugaagggaaac

SEQ ID NO: 2835 - RNA, 25 nt, Artificial Sequence
  Description of Artificial Sequence: Synthetic oligonucleotide
ucaaaagagccgcugaagggaaaca

SEQ ID NO: 2836 - RNA, 25 nt, Artificial Sequence
  Description of Artificial Sequence: Synthetic oligonucleotide
caaaagagccgcugaagggaaacag

SEQ ID NO: 2837 - RNA, 25 nt, Artificial Sequence
  Description of Artificial Sequence: Synthetic oligonucleotide
aaaagagccgcugaagggaaacaga

SEQ ID NO: 2838 - RNA, 25 nt, Artificial Sequence
  Description of Artificial Sequence: Synthetic oligonucleotide
aaagagccgcugaagggaaacagaa

SEQ ID NO: 2839 - RNA, 25 nt, Artificial Sequence
  Description of Artificial Sequence: Synthetic oligonucleotide
aagagccgcugaagggaaacagaag

SEQ ID NO: 2840 - RNA, 25 nt, Artificial Sequence
  Description of Artificial Sequence: Synthetic oligonucleotide
agagccgcugaagggaaacagaagu

SEQ ID NO: 2841 - RNA, 25 nt, Artificial Sequence
  Description of Artificial Sequence: Synthetic oligonucleotide
gagccgcugaagggaaacagaagua

SEQ ID NO: 2842 - RNA, 25 nt, Artificial Sequence
  Description of Artificial Sequence: Synthetic oligonucleotide
agccgcugaagggaaacagaaguac

SEQ ID NO: 2843 - RNA, 25 nt, Artificial Sequence
  Description of Artificial Sequence: Synthetic oligonucleotide
gccgcugaagggaaacagaaguacc

SEQ ID NO: 2844 - RNA, 25 nt, Artificial Sequence
  Description of Artificial Sequence: Synthetic oligonucleotide
ccgcugaagggaaacagaaguaccu

SEQ ID NO: 2845 - RNA, 25 nt, Artificial Sequence
  Description of Artificial Sequence: Synthetic oligonucleotide
gcugaagggaaacagaaguaccugu

SEQ ID NO: 2846 - RNA, 25 nt, Artificial Sequence
  Description of Artificial Sequence: Synthetic oligonucleotide
cugaagggaaacagaaguaccugug

SEQ ID NO: 2847 - RNA, 25 nt, Artificial Sequence
  Description of Artificial Sequence: Synthetic oligonucleotide
ugugcgccagcagaaaugauugcac

SEQ ID NO: 2848 - RNA, 25 nt, Artificial Sequence
  Description of Artificial Sequence: Synthetic oligonucleotide
agaaaugauugcacuauugauaaau

SEQ ID NO: 2849 - RNA, 25 nt, Artificial Sequence
  Description of Artificial Sequence: Synthetic oligonucleotide
ugauugcacuauugauaaauuccga

SEQ ID NO: 2850 - RNA, 25 nt, Artificial Sequence
  Description of Artificial Sequence: Synthetic oligonucleotide
cuauugauaaauuccgaaggaaaaa

SEQ ID NO: 2851 - RNA, 25 nt, Artificial Sequence
  Description of Artificial Sequence: Synthetic oligonucleotide
cggaaauguuaugaagcagggauga

SEQ ID NO: 2852 - RNA, 25 nt, Artificial Sequence
  Description of Artificial Sequence: Synthetic oligonucleotide
ggaaauguuaugaagcagggaugac

SEQ ID NO: 2853 - RNA, 25 nt, Artificial Sequence
  Description of Artificial Sequence: Synthetic oligonucleotide
gaaauguuaugaagcagggaugacu

SEQ ID NO: 2854 - RNA, 25 nt, Artificial Sequence
  Description of Artificial Sequence: Synthetic oligonucleotide
aaauguuaugaagcagggaugacuc

SEQ ID NO: 2855 - RNA, 25 nt, Artificial Sequence
  Description of Artificial Sequence: Synthetic oligonucleotide
aauguuaugaagcagggaugacucu

SEQ ID NO: 2856 - RNA, 25 nt, Artificial Sequence
  Description of Artificial Sequence: Synthetic oligonucleotide
auguuaugaagcagggaugacucug

SEQ ID NO: 2857 - RNA, 25 nt, Artificial Sequence
  Description of Artificial Sequence: Synthetic oligonucleotide
uguuaugaagcagggaugacucugg

SEQ ID NO: 2858 - RNA, 25 nt, Artificial Sequence
  Description of Artificial Sequence: Synthetic oligonucleotide
guuaugaagcagggaugacucuggg

SEQ ID NO: 2859 - RNA, 25 nt, Artificial Sequence
  Description of Artificial Sequence: Synthetic oligonucleotide
uuaugaagcagggaugacucuggga

SEQ ID NO: 2860 - RNA, 25 nt, Artificial Sequence
  Description of Artificial Sequence: Synthetic oligonucleotide
uaugaagcagggaugacucugggag

SEQ ID NO: 2861 - RNA, 25 nt, Artificial Sequence
  Description of Artificial Sequence: Synthetic oligonucleotide
augaagcagggaugacucugggagc

SEQ ID NO: 2862 - RNA, 25 nt, Artificial Sequence
  Description of Artificial Sequence: Synthetic oligonucleotide
ugaagcagggaugacucugggagcc

SEQ ID NO: 2863 - RNA, 25 nt, Artificial Sequence
  Description of Artificial Sequence: Synthetic oligonucleotide
gaagcagggaugacucugggagccc

SEQ ID NO: 2864 - RNA, 25 nt, Artificial Sequence
  Description of Artificial Sequence: Synthetic oligonucleotide
aagcagggaugacucugggagcccg

SEQ ID NO: 2865 - RNA, 25 nt, Artificial Sequence
  Description of Artificial Sequence: Synthetic oligonucleotide
agcagggaugacucugggagcccgg

SEQ ID NO: 2866 - RNA, 25 nt, Artificial Sequence
  Description of Artificial Sequence: Synthetic oligonucleotide
gcagggaugacucugggagcccgga

SEQ ID NO: 2867 - RNA, 25 nt, Artificial Sequence
  Description of Artificial Sequence: Synthetic oligonucleotide
cagggaugacucugggagcccggaa

SEQ ID NO: 2868 - RNA, 25 nt, Artificial Sequence
  Description of Artificial Sequence: Synthetic oligonucleotide
gaagaaacuugguaaucugaaacua

SEQ ID NO: 2869 - RNA, 25 nt, Artificial Sequence
  Description of Artificial Sequence: Synthetic oligonucleotide
aaacuacaggaggaaggagaggcuu

SEQ ID NO: 2870 - RNA, 25 nt, Artificial Sequence
  Description of Artificial Sequence: Synthetic oligonucleotide
aacuacaggaggaaggagaggcuuc

SEQ ID NO: 2871 - RNA, 25 nt, Artificial Sequence
  Description of Artificial Sequence: Synthetic oligonucleotide
cauugaaggcuaugaaugucagccc

SEQ ID NO: 2872 - RNA, 25 nt, Artificial Sequence
  Description of Artificial Sequence: Synthetic oligonucleotide
auugaaggcuaugaaugucagccca

SEQ ID NO: 2873 - RNA, 25 nt, Artificial Sequence
  Description of Artificial Sequence: Synthetic oligonucleotide
uugaaggcuaugaaugucagcccau

SEQ ID NO: 2874 - RNA, 25 nt, Artificial Sequence
  Description of Artificial Sequence: Synthetic oligonucleotide
ugaaggcuaugaaugucagcccauc

SEQ ID NO: 2875 - RNA, 25 nt, Artificial Sequence
  Description of Artificial Sequence: Synthetic oligonucleotide
gaaggcuaugaaugucagcccaucu

SEQ ID NO: 2876 - RNA, 25 nt, Artificial Sequence
  Description of Artificial Sequence: Synthetic oligonucleotide
aaggcuaugaaugucagcccaucuu

SEQ ID NO: 2877 - RNA, 25 nt, Artificial Sequence
  Description of Artificial Sequence: Synthetic oligonucleotide
guccuggaagccauugagccaggug

SEQ ID NO: 2878 - RNA, 25 nt, Artificial Sequence
  Description of Artificial Sequence: Synthetic oligonucleotide
uccuggaagccauugagccaggugu

SEQ ID NO: 2879 - RNA, 25 nt, Artificial Sequence
  Description of Artificial Sequence: Synthetic oligonucleotide
ccuggaagccauugagccaggugua

SEQ ID NO: 2880 - RNA, 25 nt, Artificial Sequence
  Description of Artificial Sequence: Synthetic oligonucleotide
cuggaagccauugagccagguguag

SEQ ID NO: 2881 - RNA, 25 nt, Artificial Sequence
  Description of Artificial Sequence: Synthetic oligonucleotide
uggaagccauugagccagguguagu

SEQ ID NO: 2882 - RNA, 25 nt, Artificial Sequence
  Description of Artificial Sequence: Synthetic oligonucleotide
cagcccgacuccuuugcagccuugc

SEQ ID NO: 2883 - RNA, 25 nt, Artificial Sequence
  Description of Artificial Sequence: Synthetic oligonucleotide
gacuccuuugcagccuugcucucua

SEQ ID NO: 2884 - RNA, 25 nt, Artificial Sequence
  Description of Artificial Sequence: Synthetic oligonucleotide
cagccuugcucucuagccucaauga

SEQ ID NO: 2885 - RNA, 25 nt, Artificial Sequence
  Description of Artificial Sequence: Synthetic oligonucleotide
guggucaagugggccaaggccuugc

SEQ ID NO: 2886 - RNA, 25 nt, Artificial Sequence
  Description of Artificial Sequence: Synthetic oligonucleotide
uggucaagugggccaaggccuugcc

SEQ ID NO: 2887 - RNA, 25 nt, Artificial Sequence
  Description of Artificial Sequence: Synthetic oligonucleotide
ggucaagugggccaaggccuugccu

SEQ ID NO: 2888 - RNA, 25 nt, Artificial Sequence
  Description of Artificial Sequence: Synthetic oligonucleotide
gucaagugggccaaggccuugccug

SEQ ID NO: 2889 - RNA, 25 nt, Artificial Sequence
  Description of Artificial Sequence: Synthetic oligonucleotide
ucaagugggccaaggccuugccugg

SEQ ID NO: 2890 - RNA, 25 nt, Artificial Sequence
  Description of Artificial Sequence: Synthetic oligonucleotide
caagugggccaaggccuugccuggc

SEQ ID NO: 2891 - RNA, 25 nt, Artificial Sequence
  Description of Artificial Sequence: Synthetic oligonucleotide
aagugggccaaggccuugccuggcu

SEQ ID NO: 2892 - RNA, 25 nt, Artificial Sequence
  Description of Artificial Sequence: Synthetic oligonucleotide
agugggccaaggccuugccuggcuu

SEQ ID NO: 2893 - RNA, 25 nt, Artificial Sequence
  Description of Artificial Sequence: Synthetic oligonucleotide
gugggccaaggccuugccuggcuuc

SEQ ID NO: 2894 - RNA, 25 nt, Artificial Sequence
  Description of Artificial Sequence: Synthetic oligonucleotide
ugggccaaggccuugccuggcuucc

SEQ ID NO: 2895 - RNA, 25 nt, Artificial Sequence
  Description of Artificial Sequence: Synthetic oligonucleotide
gggccaaggccuugccuggcuuccg

SEQ ID NO: 2896 - RNA, 25 nt, Artificial Sequence
  Description of Artificial Sequence: Synthetic oligonucleotide
ggccaaggccuugccuggcuuccgc

SEQ ID NO: 2897 - RNA, 25 nt, Artificial Sequence
  Description of Artificial Sequence: Synthetic oligonucleotide
gccaaggccuugccuggcuuccgca

SEQ ID NO: 2898 - RNA, 25 nt, Artificial Sequence
  Description of Artificial Sequence: Synthetic oligonucleotide
ccaaggccuugccuggcuuccgcaa

SEQ ID NO: 2899 - RNA, 25 nt, Artificial Sequence
  Description of Artificial Sequence: Synthetic oligonucleotide
caaggccuugccuggcuuccgcaac

SEQ ID NO: 2900 - RNA, 25 nt, Artificial Sequence
  Description of Artificial Sequence: Synthetic oligonucleotide
aaggccuugccuggcuuccgcaacu

SEQ ID NO: 2901 - RNA, 25 nt, Artificial Sequence
  Description of Artificial Sequence: Synthetic oligonucleotide
aggccuugccuggcuuccgcaacuu

SEQ ID NO: 2902 - RNA, 25 nt, Artificial Sequence
  Description of Artificial Sequence: Synthetic oligonucleotide
ggccuugccuggcuuccgcaacuua

SEQ ID NO: 2903 - RNA, 25 nt, Artificial Sequence
  Description of Artificial Sequence: Synthetic oligonucleotide
gccuugccuggcuuccgcaacuuac

SEQ ID NO: 2904 - RNA, 25 nt, Artificial Sequence
  Description of Artificial Sequence: Synthetic oligonucleotide
ccuugccuggcuuccgcaacuuaca

SEQ ID NO: 2905 - RNA, 25 nt, Artificial Sequence
  Description of Artificial Sequence: Synthetic oligonucleotide
cuugccuggcuuccgcaacuuacac

SEQ ID NO: 2906 - RNA, 25 nt, Artificial Sequence
  Description of Artificial Sequence: Synthetic oligonucleotide
uugccuggcuuccgcaacuuacacg

SEQ ID NO: 2907 - RNA, 25 nt, Artificial Sequence
  Description of Artificial Sequence: Synthetic oligonucleotide
ugccuggcuuccgcaacuuacacgu

SEQ ID NO: 2908 - RNA, 25 nt, Artificial Sequence
  Description of Artificial Sequence: Synthetic oligonucleotide
aaugucaacuccaggaugcucuacu

SEQ ID NO: 2909 - RNA, 25 nt, Artificial Sequence
  Description of Artificial Sequence: Synthetic oligonucleotide
augucaacuccaggaugcucuacuu

SEQ ID NO: 2910 - RNA, 25 nt, Artificial Sequence
  Description of Artificial Sequence: Synthetic oligonucleotide
ugucaacuccaggaugcucuacuuc

SEQ ID NO: 2911 - RNA, 25 nt, Artificial Sequence
  Description of Artificial Sequence: Synthetic oligonucleotide
gucaacuccaggaugcucuacuucg

SEQ ID NO: 2912 - RNA, 25 nt, Artificial Sequence
  Description of Artificial Sequence: Synthetic oligonucleotide
ucaacuccaggaugcucuacuucgc

SEQ ID NO: 2913 - RNA, 25 nt, Artificial Sequence
  Description of Artificial Sequence: Synthetic oligonucleotide
caacuccaggaugcucuacuucgcc

SEQ ID NO: 2914 - RNA, 25 nt, Artificial Sequence
  Description of Artificial Sequence: Synthetic oligonucleotide
aacuccaggaugcucuacuucgccc

SEQ ID NO: 2915 - RNA, 25 nt, Artificial Sequence
  Description of Artificial Sequence: Synthetic oligonucleotide
ugguuuucaaugaguaccgcaugca

SEQ ID NO: 2916 - RNA, 25 nt, Artificial Sequence
  Description of Artificial Sequence: Synthetic oligonucleotide
gguuuucaaugaguaccgcaugcac

SEQ ID NO: 2917 - RNA, 25 nt, Artificial Sequence
  Description of Artificial Sequence: Synthetic oligonucleotide
guuuucaaugaguaccgcaugcaca

SEQ ID NO: 2918 - RNA, 25 nt, Artificial Sequence
  Description of Artificial Sequence: Synthetic oligonucleotide
uuuucaaugaguaccgcaugcacaa

SEQ ID NO: 2919 - RNA, 25 nt, Artificial Sequence
  Description of Artificial Sequence: Synthetic oligonucleotide
uuucaaugaguaccgcaugcacaag

SEQ ID NO: 2920 - RNA, 25 nt, Artificial Sequence
  Description of Artificial Sequence: Synthetic oligonucleotide
uucaaugaguaccgcaugcacaagu

SEQ ID NO: 2921 - RNA, 25 nt, Artificial Sequence
  Description of Artificial Sequence: Synthetic oligonucleotide
ucaaugaguaccgcaugcacaaguc

SEQ ID NO: 2922 - RNA, 25 nt, Artificial Sequence
  Description of Artificial Sequence: Synthetic oligonucleotide
caaugaguaccgcaugcacaagucc

SEQ ID NO: 2923 - RNA, 25 nt, Artificial Sequence
  Description of Artificial Sequence: Synthetic oligonucleotide
aaugaguaccgcaugcacaaguccc

SEQ ID NO: 2924 - RNA, 25 nt, Artificial Sequence
  Description of Artificial Sequence: Synthetic oligonucleotide
augaguaccgcaugcacaagucccg

SEQ ID NO: 2925 - RNA, 25 nt, Artificial Sequence
  Description of Artificial Sequence: Synthetic oligonucleotide
ugaguaccgcaugcacaagucccgg

SEQ ID NO: 2926 - RNA, 25 nt, Artificial Sequence
  Description of Artificial Sequence: Synthetic oligonucleotide
gaguaccgcaugcacaagucccgga

SEQ ID NO: 2927 - RNA, 25 nt, Artificial Sequence
  Description of Artificial Sequence: Synthetic oligonucleotide
aguaccgcaugcacaagucccggau

SEQ ID NO: 2928 - RNA, 25 nt, Artificial Sequence
  Description of Artificial Sequence: Synthetic oligonucleotide
ucucaagaguuuggauggcuccaaa

SEQ ID NO: 2929 - RNA, 25 nt, Artificial Sequence
  Description of Artificial Sequence: Synthetic oligonucleotide
cucaagaguuuggauggcuccaaau

SEQ ID NO: 2930 - RNA, 25 nt, Artificial Sequence
  Description of Artificial Sequence: Synthetic oligonucleotide
ucaagaguuuggauggcuccaaauc

SEQ ID NO: 2931 - RNA, 25 nt, Artificial Sequence
  Description of Artificial Sequence: Synthetic oligonucleotide
caagaguuuggauggcuccaaauca

SEQ ID NO: 2932 - RNA, 25 nt, Artificial Sequence
  Description of Artificial Sequence: Synthetic oligonucleotide
aagaguuuggauggcuccaaaucac

SEQ ID NO: 2933 - RNA, 25 nt, Artificial Sequence
  Description of Artificial Sequence: Synthetic oligonucleotide
agaguuuggauggcuccaaaucacc

SEQ ID NO: 2934 - RNA, 25 nt, Artificial Sequence
  Description of Artificial Sequence: Synthetic oligonucleotide
gaguuuggauggcuccaaaucaccc

SEQ ID NO: 2935 - RNA, 25 nt, Artificial Sequence
  Description of Artificial Sequence: Synthetic oligonucleotide
caggaauuccugugcaugaaagcac

SEQ ID NO: 2936 - RNA, 25 nt, Artificial Sequence
  Description of Artificial Sequence: Synthetic oligonucleotide
aggaauuccugugcaugaaagcacu

SEQ ID NO: 2937 - RNA, 25 nt, Artificial Sequence
  Description of Artificial Sequence: Synthetic oligonucleotide
ggaauuccugugcaugaaagcacug

SEQ ID NO: 2938 - RNA, 25 nt, Artificial Sequence
  Description of Artificial Sequence: Synthetic oligonucleotide
gaauuccugugcaugaaagcacugc

SEQ ID NO: 2939 - RNA, 25 nt, Artificial Sequence
  Description of Artificial Sequence: Synthetic oligonucleotide
aauuccugugcaugaaagcacugcu

SEQ ID NO: 2940 - RNA, 25 nt, Artificial Sequence
  Description of Artificial Sequence: Synthetic oligonucleotide
auuccugugcaugaaagcacugcua

SEQ ID NO: 2941 - RNA, 25 nt, Artificial Sequence
  Description of Artificial Sequence: Synthetic oligonucleotide
uuccugugcaugaaagcacugcuac

SEQ ID NO: 2942 - RNA, 25 nt, Artificial Sequence
  Description of Artificial Sequence: Synthetic oligonucleotide
uccugugcaugaaagcacugcuacu

SEQ ID NO: 2943 - RNA, 25 nt, Artificial Sequence
  Description of Artificial Sequence: Synthetic oligonucleotide
ccugugcaugaaagcacugcuacuc

SEQ ID NO: 2944 - RNA, 25 nt, Artificial Sequence
  Description of Artificial Sequence: Synthetic oligonucleotide
cugugcaugaaagcacugcuacucu

SEQ ID NO: 2945 - RNA, 25 nt, Artificial Sequence
  Description of Artificial Sequence: Synthetic oligonucleotide
ugugcaugaaagcacugcuacucuu

SEQ ID NO: 2946 - RNA, 25 nt, Artificial Sequence
  Description of Artificial Sequence: Synthetic oligonucleotide
cucuucagcauuauuccaguggaug

SEQ ID NO: 2947 - RNA, 25 nt, Artificial Sequence
  Description of Artificial Sequence: Synthetic oligonucleotide
ucuucagcauuauuccaguggaugg

SEQ ID NO: 2948 - RNA, 25 nt, Artificial Sequence
  Description of Artificial Sequence: Synthetic oligonucleotide
cuucagcauuauuccaguggauggg

SEQ ID NO: 2949 - RNA, 25 nt, Artificial Sequence
  Description of Artificial Sequence: Synthetic oligonucleotide
uucagcauuauuccaguggaugggc

SEQ ID NO: 2950 - RNA, 25 nt, Artificial Sequence
  Description of Artificial Sequence: Synthetic oligonucleotide
ucagcauuauuccaguggaugggcu

SEQ ID NO: 2951 - RNA, 25 nt, Artificial Sequence
  Description of Artificial Sequence: Synthetic oligonucleotide
cagcauuauuccaguggaugggcug

SEQ ID NO: 2952 - RNA, 25 nt, Artificial Sequence
  Description of Artificial Sequence: Synthetic oligonucleotide
agcauuauuccaguggaugggcuga

SEQ ID NO: 2953 - RNA, 25 nt, Artificial Sequence
  Description of Artificial Sequence: Synthetic oligonucleotide
gcauuauuccaguggaugggcugaa

SEQ ID NO: 2954 - RNA, 25 nt, Artificial Sequence
  Description of Artificial Sequence: Synthetic oligonucleotide
cauuauuccaguggaugggcugaaa

SEQ ID NO: 2955 - RNA, 25 nt, Artificial Sequence
  Description of Artificial Sequence: Synthetic oligonucleotide
auuauuccaguggaugggcugaaaa

SEQ ID NO: 2956 - RNA, 25 nt, Artificial Sequence
  Description of Artificial Sequence: Synthetic oligonucleotide
uuauuccaguggaugggcugaaaaa

SEQ ID NO: 2957 - RNA, 25 nt, Artificial Sequence
  Description of Artificial Sequence: Synthetic oligonucleotide
uauuccaguggaugggcugaaaaau

SEQ ID NO: 2958 - RNA, 25 nt, Artificial Sequence
  Description of Artificial Sequence: Synthetic oligonucleotide
auuccaguggaugggcugaaaaauc

SEQ ID NO: 2959 - RNA, 25 nt, Artificial Sequence
  Description of Artificial Sequence: Synthetic oligonucleotide
uuccaguggaugggcugaaaaauca

SEQ ID NO: 2960 - RNA, 25 nt, Artificial Sequence
  Description of Artificial Sequence: Synthetic oligonucleotide
uccaguggaugggcugaaaaaucaa

SEQ ID NO: 2961 - RNA, 25 nt, Artificial Sequence
  Description of Artificial Sequence: Synthetic oligonucleotide
ccaguggaugggcugaaaaaucaaa

SEQ ID NO: 2962 - RNA, 25 nt, Artificial Sequence
  Description of Artificial Sequence: Synthetic oligonucleotide
caguggaugggcugaaaaaucaaaa

SEQ ID NO: 2963 - RNA, 25 nt, Artificial Sequence
  Description of Artificial Sequence: Synthetic oligonucleotide
aguggaugggcugaaaaaucaaaaa

SEQ ID NO: 2964 - RNA, 25 nt, Artificial Sequence
  Description of Artificial Sequence: Synthetic oligonucleotide
guggaugggcugaaaaaucaaaaau

SEQ ID NO: 2965 - RNA, 25 nt, Artificial Sequence
  Description of Artificial Sequence: Synthetic oligonucleotide
uggaugggcugaaaaaucaaaaauu

SEQ ID NO: 2966 - RNA, 25 nt, Artificial Sequence
  Description of Artificial Sequence: Synthetic oligonucleotide
ggaugggcugaaaaaucaaaaauuc

SEQ ID NO: 2967 - RNA, 25 nt, Artificial Sequence
  Description of Artificial Sequence: Synthetic oligonucleotide
gaugggcugaaaaaucaaaaauucu

SEQ ID NO: 2968 - RNA, 25 nt, Artificial Sequence
  Description of Artificial Sequence: Synthetic oligonucleotide
augggcugaaaaaucaaaaauucuu

SEQ ID NO: 2969 - RNA, 25 nt, Artificial Sequence
  Description of Artificial Sequence: Synthetic oligonucleotide
ugggcugaaaaaucaaaaauucuuu

SEQ ID NO: 2970 - RNA, 25 nt, Artificial Sequence
  Description of Artificial Sequence: Synthetic oligonucleotide
gggcugaaaaaucaaaaauucuuug

SEQ ID NO: 2971 - RNA, 25 nt, Artificial Sequence
  Description of Artificial Sequence: Synthetic oligonucleotide
ggcugaaaaaucaaaaauucuuuga

SEQ ID NO: 2972 - RNA, 25 nt, Artificial Sequence
  Description of Artificial Sequence: Synthetic oligonucleotide
gcugaaaaaucaaaaauucuuugau

SEQ ID NO: 2973 - RNA, 25 nt, Artificial Sequence
  Description of Artificial Sequence: Synthetic oligonucleotide
cugaaaaaucaaaaauucuuugaug

SEQ ID NO: 2974 - RNA, 25 nt, Artificial Sequence
  Description of Artificial Sequence: Synthetic oligonucleotide
ugaaaaaucaaaaauucuuugauga

SEQ ID NO: 2975 - RNA, 25 nt, Artificial Sequence
  Description of Artificial Sequence: Synthetic oligonucleotide
gaaaaaucaaaaauucuuugaugaa

SEQ ID NO: 2976 - RNA, 25 nt, Artificial Sequence
  Description of Artificial Sequence: Synthetic oligonucleotide
aaaaaucaaaaauucuuugaugaac

SEQ ID NO: 2977 - RNA, 25 nt, Artificial Sequence
  Description of Artificial Sequence: Synthetic oligonucleotide
aaaucaaaaauucuuugaugaacuu

SEQ ID NO: 2978 - RNA, 25 nt, Artificial Sequence
  Description of Artificial Sequence: Synthetic oligonucleotide
aaucaaaaauucuuugaugaacuuc

SEQ ID NO: 2979 - RNA, 25 nt, Artificial Sequence
  Description of Artificial Sequence: Synthetic oligonucleotide
aucaaaaauucuuugaugaacuucg

SEQ ID NO: 2980 - RNA, 25 nt, Artificial Sequence
  Description of Artificial Sequence: Synthetic oligonucleotide
ucaaaaauucuuugaugaacuucga

SEQ ID NO: 2981 - RNA, 25 nt, Artificial Sequence
  Description of Artificial Sequence: Synthetic oligonucleotide
caaaaauucuuugaugaacuucgaa

SEQ ID NO: 2982 - RNA, 25 nt, Artificial Sequence
  Description of Artificial Sequence: Synthetic oligonucleotide
aaaaauucuuugaugaacuucgaau

SEQ ID NO: 2983 - RNA, 25 nt, Artificial Sequence
  Description of Artificial Sequence: Synthetic oligonucleotide
aaaauucuuugaugaacuucgaaug

SEQ ID NO: 2984 - RNA, 25 nt, Artificial Sequence
  Description of Artificial Sequence: Synthetic oligonucleotide
aaauucuuugaugaacuucgaauga

SEQ ID NO: 2985 - RNA, 25 nt, Artificial Sequence
  Description of Artificial Sequence: Synthetic oligonucleotide
aauucuuugaugaacuucgaaugaa

SEQ ID NO: 2986 - RNA, 25 nt, Artificial Sequence
  Description of Artificial Sequence: Synthetic oligonucleotide
auucuuugaugaacuucgaaugaac

SEQ ID NO: 2987 - RNA, 25 nt, Artificial Sequence
  Description of Artificial Sequence: Synthetic oligonucleotide
uucuuugaugaacuucgaaugaacu

SEQ ID NO: 2988 - RNA, 25 nt, Artificial Sequence
  Description of Artificial Sequence: Synthetic oligonucleotide
ucuuugaugaacuucgaaugaacua

SEQ ID NO: 2989 - RNA, 25 nt, Artificial Sequence
  Description of Artificial Sequence: Synthetic oligonucleotide
cuuugaugaacuucgaaugaacuac

SEQ ID NO: 2990 - RNA, 25 nt, Artificial Sequence
  Description of Artificial Sequence: Synthetic oligonucleotide
uuugaugaacuucgaaugaacuaca

SEQ ID NO: 2991 - RNA, 25 nt, Artificial Sequence
  Description of Artificial Sequence: Synthetic oligonucleotide
uugaugaacuucgaaugaacuacau

SEQ ID NO: 2992 - RNA, 25 nt, Artificial Sequence
  Description of Artificial Sequence: Synthetic oligonucleotide
ugaugaacuucgaaugaacuacauc

SEQ ID NO: 2993 - RNA, 25 nt, Artificial Sequence
  Description of Artificial Sequence: Synthetic oligonucleotide
gaugaacuucgaaugaacuacauca

SEQ ID NO: 2994 - RNA, 25 nt, Artificial Sequence
  Description of Artificial Sequence: Synthetic oligonucleotide
augaacuucgaaugaacuacaucaa

SEQ ID NO: 2995 - RNA, 25 nt, Artificial Sequence
  Description of Artificial Sequence: Synthetic oligonucleotide
ugaacuucgaaugaacuacaucaag

SEQ ID NO: 2996 - RNA, 25 nt, Artificial Sequence
  Description of Artificial Sequence: Synthetic oligonucleotide
gaacuucgaaugaacuacaucaagg

SEQ ID NO: 2997 - RNA, 25 nt, Artificial Sequence
  Description of Artificial Sequence: Synthetic oligonucleotide
aacuucgaaugaacuacaucaagga

SEQ ID NO: 2998 - RNA, 25 nt, Artificial Sequence
  Description of Artificial Sequence: Synthetic oligonucleotide
acuucgaaugaacuacaucaaggaa

SEQ ID NO: 2999 - RNA, 25 nt, Artificial Sequence
  Description of Artificial Sequence: Synthetic oligonucleotide
cuucgaaugaacuacaucaaggaac

SEQ ID NO: 3000 - RNA, 25 nt, Artificial Sequence
  Description of Artificial Sequence: Synthetic oligonucleotide
uucgaaugaacuacaucaaggaacu

SEQ ID NO: 3001 - RNA, 25 nt, Artificial Sequence
  Description of Artificial Sequence: Synthetic oligonucleotide
ucgaaugaacuacaucaaggaacuc

SEQ ID NO: 3002 - RNA, 25 nt, Artificial Sequence
  Description of Artificial Sequence: Synthetic oligonucleotide
cgaaugaacuacaucaaggaacucg

SEQ ID NO: 3003 - RNA, 25 nt, Artificial Sequence
  Description of Artificial Sequence: Synthetic oligonucleotide
gaaugaacuacaucaaggaacucga

SEQ ID NO: 3004 - RNA, 25 nt, Artificial Sequence
  Description of Artificial Sequence: Synthetic oligonucleotide
aaugaacuacaucaaggaacucgau

SEQ ID NO: 3005 - RNA, 25 nt, Artificial Sequence
  Description of Artificial Sequence: Synthetic oligonucleotide
augaacuacaucaaggaacucgauc

SEQ ID NO: 3006 - RNA, 25 nt, Artificial Sequence
  Description of Artificial Sequence: Synthetic oligonucleotide
ugaacuacaucaaggaacucgaucg

SEQ ID NO: 3007 - RNA, 25 nt, Artificial Sequence
  Description of Artificial Sequence: Synthetic oligonucleotide
gaacuacaucaaggaacucgaucgu

SEQ ID NO: 3008 - RNA, 25 nt, Artificial Sequence
  Description of Artificial Sequence: Synthetic oligonucleotide
aacuacaucaaggaacucgaucgua

SEQ ID NO: 3009 - RNA, 25 nt, Artificial Sequence
  Description of Artificial Sequence: Synthetic oligonucleotide
acuacaucaaggaacucgaucguau

SEQ ID NO: 3010 - RNA, 25 nt, Artificial Sequence
  Description of Artificial Sequence: Synthetic oligonucleotide
cuacaucaaggaacucgaucguauc

SEQ ID NO: 3011 - RNA, 25 nt, Artificial Sequence
  Description of Artificial Sequence: Synthetic oligonucleotide
uacaucaaggaacucgaucguauca

SEQ ID NO: 3012 - RNA, 25 nt, Artificial Sequence
  Description of Artificial Sequence: Synthetic oligonucleotide
acaucaaggaacucgaucguaucau

SEQ ID NO: 3013 - RNA, 25 nt, Artificial Sequence
  Description of Artificial Sequence: Synthetic oligonucleotide
aucauugcaugcaaaagaaaaaauc

SEQ ID NO: 3014 - RNA, 25 nt, Artificial Sequence
  Description of Artificial Sequence: Synthetic oligonucleotide
ucauugcaugcaaaagaaaaaaucc

SEQ ID NO: 3015 - RNA, 25 nt, Artificial Sequence
  Description of Artificial Sequence: Synthetic oligonucleotide
aaucccacauccugcucaagacgcu

SEQ ID NO: 3016 - RNA, 25 nt, Artificial Sequence
  Description of Artificial Sequence: Synthetic oligonucleotide
aucccacauccugcucaagacgcuu

SEQ ID NO: 3017 - RNA, 25 nt, Artificial Sequence
  Description of Artificial Sequence: Synthetic oligonucleotide
cgcuucuaccagcucaccaagcucc

SEQ ID NO: 3018 - RNA, 25 nt, Artificial Sequence
  Description of Artificial Sequence: Synthetic oligonucleotide
gcuucuaccagcucaccaagcuccu

SEQ ID NO: 3019 - RNA, 25 nt, Artificial Sequence
  Description of Artificial Sequence: Synthetic oligonucleotide
cuucuaccagcucaccaagcuccug

SEQ ID NO: 3020 - RNA, 25 nt, Artificial Sequence
  Description of Artificial Sequence: Synthetic oligonucleotide
uucuaccagcucaccaagcuccugg

SEQ ID NO: 3021 - RNA, 25 nt, Artificial Sequence
  Description of Artificial Sequence: Synthetic oligonucleotide
ucuaccagcucaccaagcuccugga

SEQ ID NO: 3022 - RNA, 25 nt, Artificial Sequence
  Description of Artificial Sequence: Synthetic oligonucleotide
cuaccagcucaccaagcuccuggac

SEQ ID NO: 3023 - RNA, 25 nt, Artificial Sequence
  Description of Artificial Sequence: Synthetic oligonucleotide
uaccagcucaccaagcuccuggacu

SEQ ID NO: 3024 - RNA, 25 nt, Artificial Sequence
  Description of Artificial Sequence: Synthetic oligonucleotide
accagcucaccaagcuccuggacuc

SEQ ID NO: 3025 - RNA, 25 nt, Artificial Sequence
  Description of Artificial Sequence: Synthetic oligonucleotide
ccagcucaccaagcuccuggacucc

SEQ ID NO: 3026 - RNA, 25 nt, Artificial Sequence
  Description of Artificial Sequence: Synthetic oligonucleotide
cagcucaccaagcuccuggacuccg

SEQ ID NO: 3027 - RNA, 25 nt, Artificial Sequence
  Description of Artificial Sequence: Synthetic oligonucleotide
agcucaccaagcuccuggacuccgu

SEQ ID NO: 3028 - RNA, 25 nt, Artificial Sequence
  Description of Artificial Sequence: Synthetic oligonucleotide
cucaccaagcuccuggacuccgugc

SEQ ID NO: 3029 - RNA, 25 nt, Artificial Sequence
  Description of Artificial Sequence: Synthetic oligonucleotide
cuccuggacuccgugcagccuauug

SEQ ID NO: 3030 - RNA, 25 nt, Artificial Sequence
  Description of Artificial Sequence: Synthetic oligonucleotide
cgugcagccuauugcgagagagcug

SEQ ID NO: 3031 - RNA, 25 nt, Artificial Sequence
  Description of Artificial Sequence: Synthetic oligonucleotide
agagagcugcaucaguucacuuuug

SEQ ID NO: 3032 - RNA, 25 nt, Artificial Sequence
  Description of Artificial Sequence: Synthetic oligonucleotide
gagagcugcaucaguucacuuuuga

SEQ ID NO: 3033 - RNA, 25 nt, Artificial Sequence
  Description of Artificial Sequence: Synthetic oligonucleotide
agagcugcaucaguucacuuuugac

SEQ ID NO: 3034 - RNA, 25 nt, Artificial Sequence
  Description of Artificial Sequence: Synthetic oligonucleotide
gagcugcaucaguucacuuuugacc

SEQ ID NO: 3035 - RNA, 25 nt, Artificial Sequence
  Description of Artificial Sequence: Synthetic oligonucleotide
agcugcaucaguucacuuuugaccu

SEQ ID NO: 3036 - RNA, 25 nt, Artificial Sequence
  Description of Artificial Sequence: Synthetic oligonucleotide
gcugcaucaguucacuuuugaccug

SEQ ID NO: 3037 - RNA, 25 nt, Artificial Sequence
  Description of Artificial Sequence: Synthetic oligonucleotide
cugcaucaguucacuuuugaccugc

SEQ ID NO: 3038 - RNA, 25 nt, Artificial Sequence
  Description of Artificial Sequence: Synthetic oligonucleotide
ugcaucaguucacuuuugaccugcu

SEQ ID NO: 3039 - RNA, 25 nt, Artificial Sequence
  Description of Artificial Sequence: Synthetic oligonucleotide
gcaucaguucacuuuugaccugcua

SEQ ID NO: 3040 - RNA, 25 nt, Artificial Sequence
  Description of Artificial Sequence: Synthetic oligonucleotide
caucaguucacuuuugaccugcuaa

SEQ ID NO: 3041 - RNA, 25 nt, Artificial Sequence
  Description of Artificial Sequence: Synthetic oligonucleotide
aucaguucacuuuugaccugcuaau

SEQ ID NO: 3042 - RNA, 25 nt, Artificial Sequence
  Description of Artificial Sequence: Synthetic oligonucleotide
ucaguucacuuuugaccugcuaauc

SEQ ID NO: 3043 - RNA, 25 nt, Artificial Sequence
  Description of Artificial Sequence: Synthetic oligonucleotide
caguucacuuuugaccugcuaauca

SEQ ID NO: 3044 - RNA, 25 nt, Artificial Sequence
  Description of Artificial Sequence: Synthetic oligonucleotide
aguucacuuuugaccugcuaaucaa

SEQ ID NO: 3045 - RNA, 25 nt, Artificial Sequence
  Description of Artificial Sequence: Synthetic oligonucleotide
guucacuuuugaccugcuaaucaag

SEQ ID NO: 3046 - RNA, 25 nt, Artificial Sequence
  Description of Artificial Sequence: Synthetic oligonucleotide
uucacuuuugaccugcuaaucaagu

SEQ ID NO: 3047 - RNA, 25 nt, Artificial Sequence
  Description of Artificial Sequence: Synthetic oligonucleotide
ucacuuuugaccugcuaaucaaguc

SEQ ID NO: 3048 - RNA, 25 nt, Artificial Sequence
  Description of Artificial Sequence: Synthetic oligonucleotide
cacuuuugaccugcuaaucaaguca

SEQ ID NO: 3049 - RNA, 25 nt, Artificial Sequence
  Description of Artificial Sequence: Synthetic oligonucleotide
acuuuugaccugcuaaucaagucac

SEQ ID NO: 3050 - RNA, 25 nt, Artificial Sequence
  Description of Artificial Sequence: Synthetic oligonucleotide
cuuuugaccugcuaaucaagucaca

SEQ ID NO: 3051 - RNA, 25 nt, Artificial Sequence
  Description of Artificial Sequence: Synthetic oligonucleotide
uuuugaccugcuaaucaagucacac

SEQ ID NO: 3052 - RNA, 25 nt, Artificial Sequence
  Description of Artificial Sequence: Synthetic oligonucleotide
auggugagcguggacuuuccggaaa

SEQ ID NO: 3053 - RNA, 25 nt, Artificial Sequence
  Description of Artificial Sequence: Synthetic oligonucleotide
uggugagcguggacuuuccggaaau

SEQ ID NO: 3054 - RNA, 25 nt, Artificial Sequence
  Description of Artificial Sequence: Synthetic oligonucleotide
gaaaugauggcagagaucaucucug

SEQ ID NO: 3055 - RNA, 25 nt, Artificial Sequence
  Description of Artificial Sequence: Synthetic oligonucleotide
aaaugauggcagagaucaucucugu

SEQ ID NO: 3056 - RNA, 25 nt, Artificial Sequence
  Description of Artificial Sequence: Synthetic oligonucleotide
aaugauggcagagaucaucucugug

SEQ ID NO: 3057 - RNA, 25 nt, Artificial Sequence
  Description of Artificial Sequence: Synthetic oligonucleotide
augauggcagagaucaucucugugc

SEQ ID NO: 3058 - RNA, 25 nt, Artificial Sequence
  Description of Artificial Sequence: Synthetic oligonucleotide
ugauggcagagaucaucucugugca

SEQ ID NO: 3059 - RNA, 25 nt, Artificial Sequence
  Description of Artificial Sequence: Synthetic oligonucleotide
gauggcagagaucaucucugugcaa

SEQ ID NO: 3060 - RNA, 25 nt, Artificial Sequence
  Description of Artificial Sequence: Synthetic oligonucleotide
auggcagagaucaucucugugcaag

SEQ ID NO: 3061 - RNA, 25 nt, Artificial Sequence
  Description of Artificial Sequence: Synthetic oligonucleotide
uggcagagaucaucucugugcaagu

SEQ ID NO: 3062 - RNA, 25 nt, Artificial Sequence
  Description of Artificial Sequence: Synthetic oligonucleotide
ggcagagaucaucucugugcaagug

SEQ ID NO: 3063 - RNA, 25 nt, Artificial Sequence
  Description of Artificial Sequence: Synthetic oligonucleotide
gcagagaucaucucugugcaagugc

SEQ ID NO: 3064 - RNA, 25 nt, Artificial Sequence
  Description of Artificial Sequence: Synthetic oligonucleotide
cagagaucaucucugugcaagugcc

SEQ ID NO: 3065 - RNA, 25 nt, Artificial Sequence
  Description of Artificial Sequence: Synthetic oligonucleotide
agagaucaucucugugcaagugccc

SEQ ID NO: 3066 - RNA, 25 nt, Artificial Sequence
  Description of Artificial Sequence: Synthetic oligonucleotide
gagaucaucucugugcaagugccca

SEQ ID NO: 3067 - RNA, 25 nt, Artificial Sequence
  Description of Artificial Sequence: Synthetic oligonucleotide
agaucaucucugugcaagugcccaa

SEQ ID NO: 3068 - RNA, 25 nt, Artificial Sequence
  Description of Artificial Sequence: Synthetic oligonucleotide
gaucaucucugugcaagugcccaag

SEQ ID NO: 3069 - RNA, 25 nt, Artificial Sequence
  Description of Artificial Sequence: Synthetic oligonucleotide
aucaucucugugcaagugcccaaga

SEQ ID NO: 3070 - RNA, 25 nt, Artificial Sequence
  Description of Artificial Sequence: Synthetic oligonucleotide
ucaucucugugcaagugcccaagau

SEQ ID NO: 3071 - RNA, 25 nt, Artificial Sequence
  Description of Artificial Sequence: Synthetic oligonucleotide
caucucugugcaagugcccaagauc

SEQ ID NO: 3072 - RNA, 25 nt, Artificial Sequence
  Description of Artificial Sequence: Synthetic oligonucleotide
aucucugugcaagugcccaagaucc

SEQ ID NO: 3073 - RNA, 25 nt, Artificial Sequence
  Description of Artificial Sequence: Synthetic oligonucleotide
ucucugugcaagugcccaagauccu

SEQ ID NO: 3074 - RNA, 25 nt, Artificial Sequence
  Description of Artificial Sequence: Synthetic oligonucleotide
cucugugcaagugcccaagauccuu

SEQ ID NO: 3075 - RNA, 25 nt, Artificial Sequence
  Description of Artificial Sequence: Synthetic oligonucleotide
ucugugcaagugcccaagauccuuu

SEQ ID NO: 3076 - RNA, 25 nt, Artificial Sequence
  Description of Artificial Sequence: Synthetic oligonucleotide
cugugcaagugcccaagauccuuuc

SEQ ID NO: 3077 - RNA, 25 nt, Artificial Sequence
  Description of Artificial Sequence: Synthetic oligonucleotide
ugugcaagugcccaagauccuuucu

SEQ ID NO: 3078 - RNA, 25 nt, Artificial Sequence
  Description of Artificial Sequence: Synthetic oligonucleotide
gugcaagugcccaagauccuuucug

SEQ ID NO: 3079 - RNA, 25 nt, Artificial Sequence
  Description of Artificial Sequence: Synthetic oligonucleotide
ugcaagugcccaagauccuuucugg

SEQ ID NO: 3080 - RNA, 25 nt, Artificial Sequence
  Description of Artificial Sequence: Synthetic oligonucleotide
gcaagugcccaagauccuuucuggg

SEQ ID NO: 3081 - RNA, 25 nt, Artificial Sequence
  Description of Artificial Sequence: Synthetic oligonucleotide
caagugcccaagauccuuucuggga

SEQ ID NO: 3082 - RNA, 25 nt, Artificial Sequence
  Description of Artificial Sequence: Synthetic oligonucleotide
aagugcccaagauccuuucugggaa

SEQ ID NO: 3083 - RNA, 25 nt, Artificial Sequence
  Description of Artificial Sequence: Synthetic oligonucleotide
agugcccaagauccuuucugggaaa

SEQ ID NO: 3084 - RNA, 25 nt, Artificial Sequence
  Description of Artificial Sequence: Synthetic oligonucleotide
gugcccaagauccuuucugggaaag

SEQ ID NO: 3085 - RNA, 25 nt, Artificial Sequence
  Description of Artificial Sequence: Synthetic oligonucleotide
ugcccaagauccuuucugggaaagu

SEQ ID NO: 3086 - RNA, 25 nt, Artificial Sequence
  Description of Artificial Sequence: Synthetic oligonucleotide
gcccaagauccuuucugggaaaguc

SEQ ID NO: 3087 - RNA, 25 nt, Artificial Sequence
  Description of Artificial Sequence: Synthetic oligonucleotide
cccaagauccuuucugggaaaguca

SEQ ID NO: 3088 - RNA, 25 nt, Artificial Sequence
  Description of Artificial Sequence: Synthetic oligonucleotide
ccaagauccuuucugggaaagucaa

SEQ ID NO: 3089 - RNA, 25 nt, Artificial Sequence
  Description of Artificial Sequence: Synthetic oligonucleotide
caagauccuuucugggaaagucaag

SEQ ID NO: 3090 - RNA, 25 nt, Artificial Sequence
  Description of Artificial Sequence: Synthetic oligonucleotide
aagauccuuucugggaaagucaagc

SEQ ID NO: 3091 - RNA, 25 nt, Artificial Sequence
  Description of Artificial Sequence: Synthetic oligonucleotide
agauccuuucugggaaagucaagcc

SEQ ID NO: 3092 - RNA, 25 nt, Artificial Sequence
  Description of Artificial Sequence: Synthetic oligonucleotide
gauccuuucugggaaagucaagccc

SEQ ID NO: 3093 - RNA, 25 nt, Artificial Sequence
  Description of Artificial Sequence: Synthetic oligonucleotide
auccuuucugggaaagucaagccca

SEQ ID NO: 3094 - RNA, 25 nt, Artificial Sequence
  Description of Artificial Sequence: Synthetic oligonucleotide
uccuuucugggaaagucaagcccau

SEQ ID NO: 3095 - RNA, 25 nt, Artificial Sequence
  Description of Artificial Sequence: Synthetic oligonucleotide
ccuuucugggaaagucaagcccauc

SEQ ID NO: 3096 - RNA, 25 nt, Artificial Sequence
  Description of Artificial Sequence: Synthetic oligonucleotide
cuuucugggaaagucaagcccaucu

SEQ ID NO: 3097 - RNA, 25 nt, Artificial Sequence
  Description of Artificial Sequence: Synthetic oligonucleotide
uuucugggaaagucaagcccaucua

SEQ ID NO: 3098 - RNA, 25 nt, Artificial Sequence
  Description of Artificial Sequence: Synthetic oligonucleotide
uucugggaaagucaagcccaucuau

SEQ ID NO: 3099 - RNA, 25 nt, Artificial Sequence
  Description of Artificial Sequence: Synthetic oligonucleotide
ucugggaaagucaagcccaucuauu

SEQ ID NO: 3100 - RNA, 25 nt, Artificial Sequence
  Description of Artificial Sequence: Synthetic oligonucleotide
cugggaaagucaagcccaucuauuu

SEQ ID NO: 3101 - RNA, 25 nt, Artificial Sequence
  Description of Artificial Sequence: Synthetic oligonucleotide
ugggaaagucaagcccaucuauuuc

SEQ ID NO: 3102 - RNA, 25 nt, Artificial Sequence
  Description of Artificial Sequence: Synthetic oligonucleotide
gggaaagucaagcccaucuauuucc

SEQ ID NO: 3103 - RNA, 25 nt, Artificial Sequence
  Description of Artificial Sequence: Synthetic oligonucleotide
ggaaagucaagcccaucuauuucca

SEQ ID NO: 3104 - RNA, 25 nt, Artificial Sequence
  Description of Artificial Sequence: Synthetic oligonucleotide
gaaagucaagcccaucuauuuccac

SEQ ID NO: 3105 - RNA, 25 nt, Artificial Sequence
  Description of Artificial Sequence: Synthetic oligonucleotide
aaagucaagcccaucuauuuccaca

SEQ ID NO: 3106 - RNA, 25 nt, Artificial Sequence
  Description of Artificial Sequence: Synthetic oligonucleotide
aagucaagcccaucuauuuccacac

SEQ ID NO: 3107 - RNA, 25 nt, Artificial Sequence
  Description of Artificial Sequence: Synthetic oligonucleotide
cagaugucuucugccuguuauaacu

SEQ ID NO: 3108 - RNA, 25 nt, Artificial Sequence
  Description of Artificial Sequence: Synthetic oligonucleotide
agaugucuucugccuguuauaacuc

SEQ ID NO: 3109 - RNA, 25 nt, Artificial Sequence
  Description of Artificial Sequence: Synthetic oligonucleotide
gaugucuucugccuguuauaacucu

SEQ ID NO: 3110 - RNA, 25 nt, Artificial Sequence
  Description of Artificial Sequence: Synthetic oligonucleotide
augucuucugccuguuauaacucug

SEQ ID NO: 3111 - RNA, 25 nt, Artificial Sequence
  Description of Artificial Sequence: Synthetic oligonucleotide
ggaauuuccucuauugauguacagu

SEQ ID NO: 3112 - RNA, 25 nt, Artificial Sequence
  Description of Artificial Sequence: Synthetic oligonucleotide
gcugggcuuuuuuuuucucuuucuc

SEQ ID NO: 3113 - RNA, 25 nt, Artificial Sequence
  Description of Artificial Sequence: Synthetic oligonucleotide
cugggcuuuuuuuuucucuuucucu

SEQ ID NO: 3114 - RNA, 25 nt, Artificial Sequence
  Description of Artificial Sequence: Synthetic oligonucleotide
uuuuuuuuucucuuucucuccuuuc

SEQ ID NO: 3115 - RNA, 25 nt, Artificial Sequence
  Description of Artificial Sequence: Synthetic oligonucleotide
uuuucucuuucucuccuuucuuuuu

SEQ ID NO: 3116 - RNA, 25 nt, Artificial Sequence
  Description of Artificial Sequence: Synthetic oligonucleotide
uuuuucuucuucccucccuaucuaa

SEQ ID NO: 3117 - RNA, 25 nt, Artificial Sequence
  Description of Artificial Sequence: Synthetic oligonucleotide
uuguaugccuuuaaaucugugauga

SEQ ID NO: 3118 - RNA, 25 nt, Artificial Sequence
  Description of Artificial Sequence: Synthetic oligonucleotide
ugcuuguuuacagcacuacucugug

SEQ ID NO: 3119 - RNA, 25 nt, Artificial Sequence
  Description of Artificial Sequence: Synthetic oligonucleotide
agagagcuaagauuaucuggggaaa

SEQ ID NO: 3120 - RNA, 25 nt, Artificial Sequence
  Description of Artificial Sequence: Synthetic oligonucleotide
ggaaaucaaaacaaaaacaagcaaa

SEQ ID NO: 3121 - DNA, 21 bp, Artificial Sequence
  Description of Artificial Sequence: Synthetic oligonucleotide
gagccagcttgctgggagagc

SEQ ID NO: 3122 - DNA, 21 bp, Artificial Sequence
  Description of Artificial Sequence: Synthetic oligonucleotide
cggctccagcgacagccaacg

SEQ ID NO: 3123 - DNA, 21 bp, Artificial Sequence
  Description of Artificial Sequence: Synthetic oligonucleotide
cagccaacgcctcttgcagcg

SEQ ID NO: 3124 - DNA, 21 bp, Artificial Sequence
  Description of Artificial Sequence: Synthetic oligonucleotide
gcctcttgcagcgcggcggct

SEQ ID NO: 3125 - DNA, 21 bp, Artificial Sequence
  Description of Artificial Sequence: Synthetic oligonucleotide
tgcagcgcggcggcttcgaag

SEQ ID NO: 3126 - DNA, 21 bp, Artificial Sequence
  Description of Artificial Sequence: Synthetic oligonucleotide
cgaagccgccgcccggagctg

SEQ ID NO: 3127 - DNA, 21 bp, Artificial Sequence
  Description of Artificial Sequence: Synthetic oligonucleotide
cgccgcccggagctgcccttt

SEQ ID NO: 3128 - DNA, 21 bp, Artificial Sequence
  Description of Artificial Sequence: Synthetic oligonucleotide
tgaagtttttaaaagctgcta

SEQ ID NO: 3129 - DNA, 21 bp, Artificial Sequence
  Description of Artificial Sequence: Synthetic oligonucleotide
ccgtcttctctcccgcagctg

SEQ ID NO: 3130 - DNA, 21 bp, Artificial Sequence
  Description of Artificial Sequence: Synthetic oligonucleotide
ccgcagctgcctcagtcggct

SEQ ID NO: 3131 - DNA, 21 bp, Artificial Sequence
  Description of Artificial Sequence: Synthetic oligonucleotide
tttggctgcgagcgggcgagc

SEQ ID NO: 3132 - DNA, 21 bp, Artificial Sequence
  Description of Artificial Sequence: Synthetic oligonucleotide
cgggcgagctagctgcacatt

SEQ ID NO: 3133 - DNA, 21 bp, Artificial Sequence
  Description of Artificial Sequence: Synthetic oligonucleotide
tctctctccacctcctcctgc

SEQ ID NO: 3134 - DNA, 21 bp, Artificial Sequence
  Description of Artificial Sequence: Synthetic oligonucleotide
ccagagatcaaaagatgaaaa

SEQ ID NO: 3135 - DNA, 21 bp, Artificial Sequence
  Description of Artificial Sequence: Synthetic oligonucleotide
cagtagccaaaaaacaaaaca

SEQ ID NO: 3136 - DNA, 21 bp, Artificial Sequence
  Description of Artificial Sequence: Synthetic oligonucleotide
ccaaaaaacaaaacaaacaaa

SEQ ID NO: 3137 - DNA, 21 bp, Artificial Sequence
  Description of Artificial Sequence: Synthetic oligonucleotide
acaaaacaaacaaaaacaaaa

SEQ ID NO: 3138 - DNA, 21 bp, Artificial Sequence
  Description of Artificial Sequence: Synthetic oligonucleotide
acaaaaaagccgaaataaaag

SEQ ID NO: 3139 - DNA, 21 bp, Artificial Sequence
  Description of Artificial Sequence: Synthetic oligonucleotide
gccgaaataaaagaaaaagat

SEQ ID NO: 3140 - DNA, 21 bp, Artificial Sequence
  Description of Artificial Sequence: Synthetic oligonucleotide
aagaaaaagataataactcag

SEQ ID NO: 3141 - DNA, 21 bp, Artificial Sequence
  Description of Artificial Sequence: Synthetic oligonucleotide
aaagataataactcagttctt

SEQ ID NO: 3142 - DNA, 21 bp, Artificial Sequence
  Description of Artificial Sequence: Synthetic oligonucleotide
gataataactcagttcttatt

SEQ ID NO: 3143 - DNA, 21 bp, Artificial Sequence
  Description of Artificial Sequence: Synthetic oligonucleotide
tggaggattttgtttttttct

SEQ ID NO: 3144 - DNA, 21 bp, Artificial Sequence
  Description of Artificial Sequence: Synthetic oligonucleotide
gattttgtttttttcttttaa

SEQ ID NO: 3145 - DNA, 21 bp, Artificial Sequence
  Description of Artificial Sequence: Synthetic oligonucleotide
gtttttttcttttaagatctg

SEQ ID NO: 3146 - DNA, 21 bp, Artificial Sequence
  Description of Artificial Sequence: Synthetic oligonucleotide
gggcatcttttgaatctaccc

SEQ ID NO: 3147 - DNA, 21 bp, Artificial Sequence
  Description of Artificial Sequence: Synthetic oligonucleotide
cagagcgctttttgcgtggtt

SEQ ID NO: 3148 - DNA, 21 bp, Artificial Sequence
  Description of Artificial Sequence: Synthetic oligonucleotide
cgctttttgcgtggttgctcc

SEQ ID NO: 3149 - DNA, 21 bp, Artificial Sequence
  Description of Artificial Sequence: Synthetic oligonucleotide
aagtttccttctctggagctt

SEQ ID NO: 3150 - DNA, 21 bp, Artificial Sequence
  Description of Artificial Sequence: Synthetic oligonucleotide
agcttcccgcaggtgggcagc

SEQ ID NO: 3151 - DNA, 21 bp, Artificial Sequence
  Description of Artificial Sequence: Synthetic oligonucleotide
gtgggcagctagctgcagcga

SEQ ID NO: 3152 - DNA, 21 bp, Artificial Sequence
  Description of Artificial Sequence: Synthetic oligonucleotide
aagtgcagttagggctgggaa

SEQ ID NO: 3153 - DNA, 21 bp, Artificial Sequence
  Description of Artificial Sequence: Synthetic oligonucleotide
agtgcagttagggctgggaag

SEQ ID NO: 3154 - DNA, 21 bp, Artificial Sequence
  Description of Artificial Sequence: Synthetic oligonucleotide
gtgcagttagggctgggaagg

SEQ ID NO: 3155 - DNA, 21 bp, Artificial Sequence
  Description of Artificial Sequence: Synthetic oligonucleotide
tgcagttagggctgggaaggg

SEQ ID NO: 3156 - DNA, 21 bp, Artificial Sequence
  Description of Artificial Sequence: Synthetic oligonucleotide
gcagttagggctgggaagggt

SEQ ID NO: 3157 - DNA, 21 bp, Artificial Sequence
  Description of Artificial Sequence: Synthetic oligonucleotide
cagttagggctgggaagggtc

SEQ ID NO: 3158 - DNA, 21 bp, Artificial Sequence
  Description of Artificial Sequence: Synthetic oligonucleotide
agttagggctgggaagggtct

SEQ ID NO: 3159 - DNA, 21 bp, Artificial Sequence
  Description of Artificial Sequence: Synthetic oligonucleotide
gttagggctgggaagggtcta

SEQ ID NO: 3160 - DNA, 21 bp, Artificial Sequence
  Description of Artificial Sequence: Synthetic oligonucleotide
ttagggctgggaagggtctac

SEQ ID NO: 3161 - DNA, 21 bp, Artificial Sequence
  Description of Artificial Sequence: Synthetic oligonucleotide
tagggctgggaagggtctacc

SEQ ID NO: 3162 - DNA, 21 bp, Artificial Sequence
  Description of Artificial Sequence: Synthetic oligonucleotide
agggctgggaagggtctaccc

SEQ ID NO: 3163 - DNA, 21 bp, Artificial Sequence
  Description of Artificial Sequence: Synthetic oligonucleotide
ctttccagaatctgttccaga

SEQ ID NO: 3164 - DNA, 21 bp, Artificial Sequence
  Description of Artificial Sequence: Synthetic oligonucleotide
tttccagaatctgttccagag

SEQ ID NO: 3165 - DNA, 21 bp, Artificial Sequence
  Description of Artificial Sequence: Synthetic oligonucleotide
ttccagaatctgttccagagc

SEQ ID NO: 3166 - DNA, 21 bp, Artificial Sequence
  Description of Artificial Sequence: Synthetic oligonucleotide
tccagaatctgttccagagcg

SEQ ID NO: 3167 - DNA, 21 bp, Artificial Sequence
  Description of Artificial Sequence: Synthetic oligonucleotide
ccagaatctgttccagagcgt

SEQ ID NO: 3168 - DNA, 21 bp, Artificial Sequence
  Description of Artificial Sequence: Synthetic oligonucleotide
cagaatctgttccagagcgtg

SEQ ID NO: 3169 - DNA, 21 bp, Artificial Sequence
  Description of Artificial Sequence: Synthetic oligonucleotide
agaatctgttccagagcgtgc

SEQ ID NO: 3170 - DNA, 21 bp, Artificial Sequence
  Description of Artificial Sequence: Synthetic oligonucleotide
gaatctgttccagagcgtgcg

SEQ ID NO: 3171 - DNA, 21 bp, Artificial Sequence
  Description of Artificial Sequence: Synthetic oligonucleotide
aatctgttccagagcgtgcgc

SEQ ID NO: 3172 - DNA, 21 bp, Artificial Sequence
  Description of Artificial Sequence: Synthetic oligonucleotide
atctgttccagagcgtgcgcg

SEQ ID NO: 3173 - DNA, 21 bp, Artificial Sequence
  Description of Artificial Sequence: Synthetic oligonucleotide
tctgttccagagcgtgcgcga

SEQ ID NO: 3174 - DNA, 21 bp, Artificial Sequence
  Description of Artificial Sequence: Synthetic oligonucleotide
ctgttccagagcgtgcgcgaa

SEQ ID NO: 3175 - DNA, 21 bp, Artificial Sequence
  Description of Artificial Sequence: Synthetic oligonucleotide
tgttccagagcgtgcgcgaag

SEQ ID NO: 3176 - DNA, 21 bp, Artificial Sequence
  Description of Artificial Sequence: Synthetic oligonucleotide
ggcgccagtttgctgctgctg

SEQ ID NO: 3177 - DNA, 21 bp, Artificial Sequence
  Description of Artificial Sequence: Synthetic oligonucleotide
ttgctgctgctgcagcagcag

SEQ ID NO: 3178 - DNA, 21 bp, Artificial Sequence
  Description of Artificial Sequence: Synthetic oligonucleotide
gcgtcccagagcctggagccg

SEQ ID NO: 3179 - DNA, 21 bp, Artificial Sequence
  Description of Artificial Sequence: Synthetic oligonucleotide
ggctgccgcagcagctgccag

SEQ ID NO: 3180 - DNA, 21 bp, Artificial Sequence
  Description of Artificial Sequence: Synthetic oligonucleotide
cgcagcagctgccagcacctc

SEQ ID NO: 3181 - DNA, 21 bp, Artificial Sequence
  Description of Artificial Sequence: Synthetic oligonucleotide
cccatccacgttgtccctgct

SEQ ID NO: 3182 - DNA, 21 bp, Artificial Sequence
  Description of Artificial Sequence: Synthetic oligonucleotide
ccggcttaagcagctgctccg

SEQ ID NO: 3183 - DNA, 21 bp, Artificial Sequence
  Description of Artificial Sequence: Synthetic oligonucleotide
cggcttaagcagctgctccgc

SEQ ID NO: 3184 - DNA, 21 bp, Artificial Sequence
  Description of Artificial Sequence: Synthetic oligonucleotide
taagcagctgctccgctgacc

SEQ ID NO: 3185 - DNA, 21 bp, Artificial Sequence
  Description of Artificial Sequence: Synthetic oligonucleotide
atgcaactccttcagcaacag

SEQ ID NO: 3186 - DNA, 21 bp, Artificial Sequence
  Description of Artificial Sequence: Synthetic oligonucleotide
accatttctgacaacgccaag

SEQ ID NO: 3187 - DNA, 21 bp, Artificial Sequence
  Description of Artificial Sequence: Synthetic oligonucleotide
ccacttttgggagttccaccc

SEQ ID NO: 3188 - DNA, 21 bp, Artificial Sequence
  Description of Artificial Sequence: Synthetic oligonucleotide
caggcaagagcactgaagata

SEQ ID NO: 3189 - DNA, 21 bp, Artificial Sequence
  Description of Artificial Sequence: Synthetic oligonucleotide
ctggcagcgctgcagcaggga

SEQ ID NO: 3190 - DNA, 21 bp, Artificial Sequence
  Description of Artificial Sequence: Synthetic oligonucleotide
agtcgcgactactacaacttt

SEQ ID NO: 3191 - DNA, 21 bp, Artificial Sequence
  Description of Artificial Sequence: Synthetic oligonucleotide
gtcgcgactactacaactttc

SEQ ID NO: 3192 - DNA, 21 bp, Artificial Sequence
  Description of Artificial Sequence: Synthetic oligonucleotide
tcgcgactactacaactttcc

SEQ ID NO: 3193 - DNA, 21 bp, Artificial Sequence
  Description of Artificial Sequence: Synthetic oligonucleotide
gctcgcatcaagctggagaac

SEQ ID NO: 3194 - DNA, 21 bp, Artificial Sequence
  Description of Artificial Sequence: Synthetic oligonucleotide
gctggactacggcagcgcctg

SEQ ID NO: 3195 - DNA, 21 bp, Artificial Sequence
  Description of Artificial Sequence: Synthetic oligonucleotide
ctggactacggcagcgcctgg

SEQ ID NO: 3196 - DNA, 21 bp, Artificial Sequence
  Description of Artificial Sequence: Synthetic oligonucleotide
tggactacggcagcgcctggg

SEQ ID NO: 3197 - DNA, 21 bp, Artificial Sequence
  Description of Artificial Sequence: Synthetic oligonucleotide
ggactacggcagcgcctgggc

SEQ ID NO: 3198 - DNA, 21 bp, Artificial Sequence
  Description of Artificial Sequence: Synthetic oligonucleotide
tggcgcgggtgcagcgggacc

SEQ ID NO: 3199 - DNA, 21 bp, Artificial Sequence
  Description of Artificial Sequence: Synthetic oligonucleotide
ggctggcgggccaggaaagcg

SEQ ID NO: 3200 - DNA, 21 bp, Artificial Sequence
  Description of Artificial Sequence: Synthetic oligonucleotide
gtaccctggcggcatggtgag

SEQ ID NO: 3201 - DNA, 21 bp, Artificial Sequence
  Description of Artificial Sequence: Synthetic oligonucleotide
tggatggatagctactccgga

SEQ ID NO: 3202 - DNA, 21 bp, Artificial Sequence
  Description of Artificial Sequence: Synthetic oligonucleotide
cccagaagacctgcctgatct

SEQ ID NO: 3203 - DNA, 21 bp, Artificial Sequence
  Description of Artificial Sequence: Synthetic oligonucleotide
ccagaagacctgcctgatctg

SEQ ID NO: 3204 - DNA, 21 bp, Artificial Sequence
  Description of Artificial Sequence: Synthetic oligonucleotide
cagaagacctgcctgatctgt

SEQ ID NO: 3205 - DNA, 21 bp, Artificial Sequence
  Description of Artificial Sequence: Synthetic oligonucleotide
agaagacctgcctgatctgtg

SEQ ID NO: 3206 - DNA, 21 bp, Artificial Sequence
  Description of Artificial Sequence: Synthetic oligonucleotide
gaagacctgcctgatctgtgg

SEQ ID NO: 3207 - DNA, 21 bp, Artificial Sequence
  Description of Artificial Sequence: Synthetic oligonucleotide
aagacctgcctgatctgtgga

SEQ ID NO: 3208 - DNA, 21 bp, Artificial Sequence
  Description of Artificial Sequence: Synthetic oligonucleotide
agacctgcctgatctgtggag

SEQ ID NO: 3209 - DNA, 21 bp, Artificial Sequence
  Description of Artificial Sequence: Synthetic oligonucleotide
gacctgcctgatctgtggaga

SEQ ID NO: 3210 - DNA, 21 bp, Artificial Sequence
  Description of Artificial Sequence: Synthetic oligonucleotide
acctgcctgatctgtggagat

SEQ ID NO: 3211 - DNA, 21 bp, Artificial Sequence
  Description of Artificial Sequence: Synthetic oligonucleotide
cctgcctgatctgtggagatg

SEQ ID NO: 3212 - DNA, 21 bp, Artificial Sequence
  Description of Artificial Sequence: Synthetic oligonucleotide
ctgcctgatctgtggagatga

SEQ ID NO: 3213 - DNA, 21 bp, Artificial Sequence
  Description of Artificial Sequence: Synthetic oligonucleotide
tgcctgatctgtggagatgaa

SEQ ID NO: 3214 - DNA, 21 bp, Artificial Sequence
  Description of Artificial Sequence: Synthetic oligonucleotide
gcctgatctgtggagatgaag

SEQ ID NO: 3215 - DNA, 21 bp, Artificial Sequence
  Description of Artificial Sequence: Synthetic oligonucleotide
cctgatctgtggagatgaagc

SEQ ID NO: 3216 - DNA, 21 bp, Artificial Sequence
  Description of Artificial Sequence: Synthetic oligonucleotide
ctgatctgtggagatgaagct

SEQ ID NO: 3217 - DNA, 21 bp, Artificial Sequence
  Description of Artificial Sequence: Synthetic oligonucleotide
tgatctgtggagatgaagctt

SEQ ID NO: 3218 - DNA, 21 bp, Artificial Sequence
  Description of Artificial Sequence: Synthetic oligonucleotide
gatctgtggagatgaagcttc

SEQ ID NO: 3219 - DNA, 21 bp, Artificial Sequence
  Description of Artificial Sequence: Synthetic oligonucleotide
atctgtggagatgaagcttct

SEQ ID NO: 3220 - DNA, 21 bp, Artificial Sequence
  Description of Artificial Sequence: Synthetic oligonucleotide
tctgtggagatgaagcttctg

SEQ ID NO: 3221 - DNA, 21 bp, Artificial Sequence
  Description of Artificial Sequence: Synthetic oligonucleotide
ctgtggagatgaagcttctgg

SEQ ID NO: 3222 - DNA, 21 bp, Artificial Sequence
  Description of Artificial Sequence: Synthetic oligonucleotide
gcttctgggtgtcactatgga

SEQ ID NO: 3223 - DNA, 21 bp, Artificial Sequence
  Description of Artificial Sequence: Synthetic oligonucleotide
tggagctctcacatgtggaag

SEQ ID NO: 3224 - DNA, 21 bp, Artificial Sequence
  Description of Artificial Sequence: Synthetic oligonucleotide
gaagctgcaaggtcttcttca

SEQ ID NO: 3225 - DNA, 21 bp, Artificial Sequence
  Description of Artificial Sequence: Synthetic oligonucleotide
aagctgcaaggtcttcttcaa

SEQ ID NO: 3226 - DNA, 21 bp, Artificial Sequence
  Description of Artificial Sequence: Synthetic oligonucleotide
agctgcaaggtcttcttcaaa

SEQ ID NO: 3227 - DNA, 21 bp, Artificial Sequence
  Description of Artificial Sequence: Synthetic oligonucleotide
gctgcaaggtcttcttcaaaa

SEQ ID NO: 3228 - DNA, 21 bp, Artificial Sequence
  Description of Artificial Sequence: Synthetic oligonucleotide
ctgcaaggtcttcttcaaaag

SEQ ID NO: 3229 - DNA, 21 bp, Artificial Sequence
  Description of Artificial Sequence: Synthetic oligonucleotide
tgcaaggtcttcttcaaaaga

SEQ ID NO: 3230 - DNA, 21 bp, Artificial Sequence
  Description of Artificial Sequence: Synthetic oligonucleotide
gcaaggtcttcttcaaaagag

SEQ ID NO: 3231 - DNA, 21 bp, Artificial Sequence
  Description of Artificial Sequence: Synthetic oligonucleotide
caaggtcttcttcaaaagagc

SEQ ID NO: 3232 - DNA, 21 bp, Artificial Sequence
  Description of Artificial Sequence: Synthetic oligonucleotide
aaggtcttcttcaaaagagcc

SEQ ID NO: 3233 - DNA, 21 bp, Artificial Sequence
  Description of Artificial Sequence: Synthetic oligonucleotide
aggtcttcttcaaaagagccg

SEQ ID NO: 3234 - DNA, 21 bp, Artificial Sequence
  Description of Artificial Sequence: Synthetic oligonucleotide
ggtcttcttcaaaagagccgc

SEQ ID NO: 3235 - DNA, 21 bp, Artificial Sequence
  Description of Artificial Sequence: Synthetic oligonucleotide
gtcttcttcaaaagagccgct

SEQ ID NO: 3236 - DNA, 21 bp, Artificial Sequence
  Description of Artificial Sequence: Synthetic oligonucleotide
tcttcttcaaaagagccgctg

SEQ ID NO: 3237 - DNA, 21 bp, Artificial Sequence
  Description of Artificial Sequence: Synthetic oligonucleotide
cttcttcaaaagagccgctga

SEQ ID NO: 3238 - DNA, 21 bp, Artificial Sequence
  Description of Artificial Sequence: Synthetic oligonucleotide
ttcttcaaaagagccgctgaa

SEQ ID NO: 3239 - DNA, 21 bp, Artificial Sequence
  Description of Artificial Sequence: Synthetic oligonucleotide
tcttcaaaagagccgctgaag

SEQ ID NO: 3240 - DNA, 21 bp, Artificial Sequence
  Description of Artificial Sequence: Synthetic oligonucleotide
cttcaaaagagccgctgaagg

SEQ ID NO: 3241 - DNA, 21 bp, Artificial Sequence
  Description of Artificial Sequence: Synthetic oligonucleotide
ttcaaaagagccgctgaaggg

SEQ ID NO: 3242 - DNA, 21 bp, Artificial Sequence
  Description of Artificial Sequence: Synthetic oligonucleotide
tcaaaagagccgctgaaggga

SEQ ID NO: 3243 - DNA, 21 bp, Artificial Sequence
  Description of Artificial Sequence: Synthetic oligonucleotide
caaaagagccgctgaagggaa

SEQ ID NO: 3244 - DNA, 21 bp, Artificial Sequence
  Description of Artificial Sequence: Synthetic oligonucleotide
aaaagagccgctgaagggaaa

SEQ ID NO: 3245 - DNA, 21 bp, Artificial Sequence
  Description of Artificial Sequence: Synthetic oligonucleotide
aaagagccgctgaagggaaac

SEQ ID NO: 3246 - DNA, 21 bp, Artificial Sequence
  Description of Artificial Sequence: Synthetic oligonucleotide
aagagccgctgaagggaaaca

SEQ ID NO: 3247 - DNA, 21 bp, Artificial Sequence
  Description of Artificial Sequence: Synthetic oligonucleotide
agagccgctgaagggaaacag

SEQ ID NO: 3248 - DNA, 21 bp, Artificial Sequence
  Description of Artificial Sequence: Synthetic oligonucleotide
gagccgctgaagggaaacaga

SEQ ID NO: 3249 - DNA, 21 bp, Artificial Sequence
  Description of Artificial Sequence: Synthetic oligonucleotide
agccgctgaagggaaacagaa

SEQ ID NO: 3250 - DNA, 21 bp, Artificial Sequence
  Description of Artificial Sequence: Synthetic oligonucleotide
ccgctgaagggaaacagaagt

SEQ ID NO: 3251 - DNA, 21 bp, Artificial Sequence
  Description of Artificial Sequence: Synthetic oligonucleotide
cgctgaagggaaacagaagta

SEQ ID NO: 3252 - DNA, 21 bp, Artificial Sequence
  Description of Artificial Sequence: Synthetic oligonucleotide
cctgtgcgccagcagaaatga

SEQ ID NO: 3253 - DNA, 21 bp, Artificial Sequence
  Description of Artificial Sequence: Synthetic oligonucleotide
gcagaaatgattgcactattg

SEQ ID NO: 3254 - DNA, 21 bp, Artificial Sequence
  Description of Artificial Sequence: Synthetic oligonucleotide
aatgattgcactattgataaa

SEQ ID NO: 3255 - DNA, 21 bp, Artificial Sequence
  Description of Artificial Sequence: Synthetic oligonucleotide
cactattgataaattccgaag

SEQ ID NO: 3256 - DNA, 21 bp, Artificial Sequence
  Description of Artificial Sequence: Synthetic oligonucleotide
ttcggaaatgttatgaagcag

SEQ ID NO: 3257 - DNA, 21 bp, Artificial Sequence
  Description of Artificial Sequence: Synthetic oligonucleotide
tcggaaatgttatgaagcagg

SEQ ID NO: 3258 - DNA, 21 bp, Artificial Sequence
  Description of Artificial Sequence: Synthetic oligonucleotide
cggaaatgttatgaagcaggg

SEQ ID NO: 3259 - DNA, 21 bp, Artificial Sequence
  Description of Artificial Sequence: Synthetic oligonucleotide
ggaaatgttatgaagcaggga

SEQ ID NO: 3260 - DNA, 21 bp, Artificial Sequence
  Description of Artificial Sequence: Synthetic oligonucleotide
gaaatgttatgaagcagggat

SEQ ID NO: 3261 - DNA, 21 bp, Artificial Sequence
  Description of Artificial Sequence: Synthetic oligonucleotide
aaatgttatgaagcagggatg

SEQ ID NO: 3262 - DNA, 21 bp, Artificial Sequence
  Description of Artificial Sequence: Synthetic oligonucleotide
aatgttatgaagcagggatga

SEQ ID NO: 3263 - DNA, 21 bp, Artificial Sequence
  Description of Artificial Sequence: Synthetic oligonucleotide
atgttatgaagcagggatgac

SEQ ID NO: 3264 - DNA, 21 bp, Artificial Sequence
  Description of Artificial Sequence: Synthetic oligonucleotide
tgttatgaagcagggatgact

SEQ ID NO: 3265 - DNA, 21 bp, Artificial Sequence
  Description of Artificial Sequence: Synthetic oligonucleotide
gttatgaagcagggatgactc

SEQ ID NO: 3266 - DNA, 21 bp, Artificial Sequence
  Description of Artificial Sequence: Synthetic oligonucleotide
ttatgaagcagggatgactct

SEQ ID NO: 3267 - DNA, 21 bp, Artificial Sequence
  Description of Artificial Sequence: Synthetic oligonucleotide
tatgaagcagggatgactctg

SEQ ID NO: 3268 - DNA, 21 bp, Artificial Sequence
  Description of Artificial Sequence: Synthetic oligonucleotide
atgaagcagggatgactctgg

SEQ ID NO: 3269 - DNA, 21 bp, Artificial Sequence
  Description of Artificial Sequence: Synthetic oligonucleotide
tgaagcagggatgactctggg

SEQ ID NO: 3270 - DNA, 21 bp, Artificial Sequence
  Description of Artificial Sequence: Synthetic oligonucleotide
gaagcagggatgactctggga

SEQ ID NO: 3271 - DNA, 21 bp, Artificial Sequence
  Description of Artificial Sequence: Synthetic oligonucleotide
aagcagggatgactctgggag

SEQ ID NO: 3272 - DNA, 21 bp, Artificial Sequence
  Description of Artificial Sequence: Synthetic oligonucleotide
agcagggatgactctgggagc

SEQ ID NO: 3273 - DNA, 21 bp, Artificial Sequence
  Description of Artificial Sequence: Synthetic oligonucleotide
ctgaagaaacttggtaatctg

SEQ ID NO: 3274 - DNA, 21 bp, Artificial Sequence
  Description of Artificial Sequence: Synthetic oligonucleotide
tgaaactacaggaggaaggag

SEQ ID NO: 3275 - DNA, 21 bp, Artificial Sequence
  Description of Artificial Sequence: Synthetic oligonucleotide
gaaactacaggaggaaggaga

SEQ ID NO: 3276 - DNA, 21 bp, Artificial Sequence
  Description of Artificial Sequence: Synthetic oligonucleotide
cacattgaaggctatgaatgt

SEQ ID NO: 3277 - DNA, 21 bp, Artificial Sequence
  Description of Artificial Sequence: Synthetic oligonucleotide
acattgaaggctatgaatgtc

SEQ ID NO: 3278 - DNA, 21 bp, Artificial Sequence
  Description of Artificial Sequence: Synthetic oligonucleotide
cattgaaggctatgaatgtca

SEQ ID NO: 3279 - DNA, 21 bp, Artificial Sequence
  Description of Artificial Sequence: Synthetic oligonucleotide
attgaaggctatgaatgtcag

SEQ ID NO: 3280 - DNA, 21 bp, Artificial Sequence
  Description of Artificial Sequence: Synthetic oligonucleotide
ttgaaggctatgaatgtcagc

SEQ ID NO: 3281 - DNA, 21 bp, Artificial Sequence
  Description of Artificial Sequence: Synthetic oligonucleotide
tgaaggctatgaatgtcagcc

SEQ ID NO: 3282 - DNA, 21 bp, Artificial Sequence
  Description of Artificial Sequence: Synthetic oligonucleotide
atgtcctggaagccattgagc

SEQ ID NO: 3283 - DNA, 21 bp, Artificial Sequence
  Description of Artificial Sequence: Synthetic oligonucleotide
tgtcctggaagccattgagcc

SEQ ID NO: 3284 - DNA, 21 bp, Artificial Sequence
  Description of Artificial Sequence: Synthetic oligonucleotide
gtcctggaagccattgagcca

SEQ ID NO: 3285 - DNA, 21 bp, Artificial Sequence
  Description of Artificial Sequence: Synthetic oligonucleotide
tcctggaagccattgagccag

SEQ ID NO: 3286 - DNA, 21 bp, Artificial Sequence
  Description of Artificial Sequence: Synthetic oligonucleotide
cctggaagccattgagccagg

SEQ ID NO: 3287 - DNA, 21 bp, Artificial Sequence
  Description of Artificial Sequence: Synthetic oligonucleotide
accagcccgactcctttgcag

SEQ ID NO: 3288 - DNA, 21 bp, Artificial Sequence
  Description of Artificial Sequence: Synthetic oligonucleotide
ccgactcctttgcagccttgc

SEQ ID NO: 3289 - DNA, 21 bp, Artificial Sequence
  Description of Artificial Sequence: Synthetic oligonucleotide
tgcagccttgctctctagcct

SEQ ID NO: 3290 - DNA, 21 bp, Artificial Sequence
  Description of Artificial Sequence: Synthetic oligonucleotide
acgtggtcaagtgggccaagg

SEQ ID NO: 3291 - DNA, 21 bp, Artificial Sequence
  Description of Artificial Sequence: Synthetic oligonucleotide
cgtggtcaagtgggccaaggc

SEQ ID NO: 3292 - DNA, 21 bp, Artificial Sequence
  Description of Artificial Sequence: Synthetic oligonucleotide
gtggtcaagtgggccaaggcc

SEQ ID NO: 3293 - DNA, 21 bp, Artificial Sequence
  Description of Artificial Sequence: Synthetic oligonucleotide
tggtcaagtgggccaaggcct

SEQ ID NO: 3294 - DNA, 21 bp, Artificial Sequence
  Description of Artificial Sequence: Synthetic oligonucleotide
ggtcaagtgggccaaggcctt

SEQ ID NO: 3295 - DNA, 21 bp, Artificial Sequence
  Description of Artificial Sequence: Synthetic oligonucleotide
gtcaagtgggccaaggccttg

SEQ ID NO: 3296 - DNA, 21 bp, Artificial Sequence
  Description of Artificial Sequence: Synthetic oligonucleotide
tcaagtgggccaaggccttgc

SEQ ID NO: 3297 - DNA, 21 bp, Artificial Sequence
  Description of Artificial Sequence: Synthetic oligonucleotide
caagtgggccaaggccttgcc

SEQ ID NO: 3298 - DNA, 21 bp, Artificial Sequence
  Description of Artificial Sequence: Synthetic oligonucleotide
aagtgggccaaggccttgcct

SEQ ID NO: 3299 - DNA, 21 bp, Artificial Sequence
  Description of Artificial Sequence: Synthetic oligonucleotide
agtgggccaaggccttgcctg

SEQ ID NO: 3300 - DNA, 21 bp, Artificial Sequence
  Description of Artificial Sequence: Synthetic oligonucleotide
gtgggccaaggccttgcctgg

SEQ ID NO: 3301 - DNA, 21 bp, Artificial Sequence
  Description of Artificial Sequence: Synthetic oligonucleotide
tgggccaaggccttgcctggc

SEQ ID NO: 3302 - DNA, 21 bp, Artificial Sequence
  Description of Artificial Sequence: Synthetic oligonucleotide
gggccaaggccttgcctggct

SEQ ID NO: 3303 - DNA, 21 bp, Artificial Sequence
  Description of Artificial Sequence: Synthetic oligonucleotide
ggccaaggccttgcctggctt

SEQ ID NO: 3304 - DNA, 21 bp, Artificial Sequence
  Description of Artificial Sequence: Synthetic oligonucleotide
gccaaggccttgcctggcttc

SEQ ID NO: 3305 - DNA, 21 bp, Artificial Sequence
  Description of Artificial Sequence: Synthetic oligonucleotide
ccaaggccttgcctggcttcc

SEQ ID NO: 3306 - DNA, 21 bp, Artificial Sequence
  Description of Artificial Sequence: Synthetic oligonucleotide
caaggccttgcctggcttccg

SEQ ID NO: 3307 - DNA, 21 bp, Artificial Sequence
  Description of Artificial Sequence: Synthetic oligonucleotide
aaggccttgcctggcttccgc

SEQ ID NO: 3308 - DNA, 21 bp, Artificial Sequence
  Description of Artificial Sequence: Synthetic oligonucleotide
aggccttgcctggcttccgca

SEQ ID NO: 3309 - DNA, 21 bp, Artificial Sequence
  Description of Artificial Sequence: Synthetic oligonucleotide
ggccttgcctggcttccgcaa

SEQ ID NO: 3310 - DNA, 21 bp, Artificial Sequence
  Description of Artificial Sequence: Synthetic oligonucleotide
gccttgcctggcttccgcaac

SEQ ID NO: 3311 - DNA, 21 bp, Artificial Sequence
  Description of Artificial Sequence: Synthetic oligonucleotide
ccttgcctggcttccgcaact

SEQ ID NO: 3312 - DNA, 21 bp, Artificial Sequence
  Description of Artificial Sequence: Synthetic oligonucleotide
cttgcctggcttccgcaactt

SEQ ID NO: 3313 - DNA, 21 bp, Artificial Sequence
  Description of Artificial Sequence: Synthetic oligonucleotide
ccaatgtcaactccaggatgc

SEQ ID NO: 3314 - DNA, 21 bp, Artificial Sequence
  Description of Artificial Sequence: Synthetic oligonucleotide
caatgtcaactccaggatgct

SEQ ID NO: 3315 - DNA, 21 bp, Artificial Sequence
  Description of Artificial Sequence: Synthetic oligonucleotide
aatgtcaactccaggatgctc

SEQ ID NO: 3316 - DNA, 21 bp, Artificial Sequence
  Description of Artificial Sequence: Synthetic oligonucleotide
atgtcaactccaggatgctct

SEQ ID NO: 3317 - DNA, 21 bp, Artificial Sequence
  Description of Artificial Sequence: Synthetic oligonucleotide
tgtcaactccaggatgctcta

SEQ ID NO: 3318 - DNA, 21 bp, Artificial Sequence
  Description of Artificial Sequence: Synthetic oligonucleotide
gtcaactccaggatgctctac

SEQ ID NO: 3319 - DNA, 21 bp, Artificial Sequence
  Description of Artificial Sequence: Synthetic oligonucleotide
tcaactccaggatgctctact

SEQ ID NO: 3320 - DNA, 21 bp, Artificial Sequence
  Description of Artificial Sequence: Synthetic oligonucleotide
tctggttttcaatgagtaccg

SEQ ID NO: 3321 - DNA, 21 bp, Artificial Sequence
  Description of Artificial Sequence: Synthetic oligonucleotide
ctggttttcaatgagtaccgc

SEQ ID NO: 3322 - DNA, 21 bp, Artificial Sequence
  Description of Artificial Sequence: Synthetic oligonucleotide
tggttttcaatgagtaccgca

SEQ ID NO: 3323 - DNA, 21 bp, Artificial Sequence
  Description of Artificial Sequence: Synthetic oligonucleotide
ggttttcaatgagtaccgcat

SEQ ID NO: 3324 - DNA, 21 bp, Artificial Sequence
  Description of Artificial Sequence: Synthetic oligonucleotide
gttttcaatgagtaccgcatg

SEQ ID NO: 3325 - DNA, 21 bp, Artificial Sequence
  Description of Artificial Sequence: Synthetic oligonucleotide
ttttcaatgagtaccgcatgc

SEQ ID NO: 3326 - DNA, 21 bp, Artificial Sequence
  Description of Artificial Sequence: Synthetic oligonucleotide
tttcaatgagtaccgcatgca

SEQ ID NO: 3327 - DNA, 21 bp, Artificial Sequence
  Description of Artificial Sequence: Synthetic oligonucleotide
ttcaatgagtaccgcatgcac

SEQ ID NO: 3328 - DNA, 21 bp, Artificial Sequence
  Description of Artificial Sequence: Synthetic oligonucleotide
tcaatgagtaccgcatgcaca

SEQ ID NO: 3329 - DNA, 21 bp, Artificial Sequence
  Description of Artificial Sequence: Synthetic oligonucleotide
caatgagtaccgcatgcacaa

SEQ ID NO: 3330 - DNA, 21 bp, Artificial Sequence
  Description of Artificial Sequence: Synthetic oligonucleotide
aatgagtaccgcatgcacaag

SEQ ID NO: 3331 - DNA, 21 bp, Artificial Sequence
  Description of Artificial Sequence: Synthetic oligonucleotide
atgagtaccgcatgcacaagt

SEQ ID NO: 3332 - DNA, 21 bp, Artificial Sequence
  Description of Artificial Sequence: Synthetic oligonucleotide
tgagtaccgcatgcacaagtc

SEQ ID NO: 3333 - DNA, 21 bp, Artificial Sequence
  Description of Artificial Sequence: Synthetic oligonucleotide
tctctcaagagtttggatggc

SEQ ID NO: 3334 - DNA, 21 bp, Artificial Sequence
  Description of Artificial Sequence: Synthetic oligonucleotide
ctctcaagagtttggatggct

SEQ ID NO: 3335 - DNA, 21 bp, Artificial Sequence
  Description of Artificial Sequence: Synthetic oligonucleotide
tctcaagagtttggatggctc

SEQ ID NO: 3336 - DNA, 21 bp, Artificial Sequence
  Description of Artificial Sequence: Synthetic oligonucleotide
ctcaagagtttggatggctcc

SEQ ID NO: 3337 - DNA, 21 bp, Artificial Sequence
  Description of Artificial Sequence: Synthetic oligonucleotide
tcaagagtttggatggctcca

SEQ ID NO: 3338 - DNA, 21 bp, Artificial Sequence
  Description of Artificial Sequence: Synthetic oligonucleotide
caagagtttggatggctccaa

SEQ ID NO: 3339 - DNA, 21 bp, Artificial Sequence
  Description of Artificial Sequence: Synthetic oligonucleotide
aagagtttggatggctccaaa

SEQ ID NO: 3340 - DNA, 21 bp, Artificial Sequence
  Description of Artificial Sequence: Synthetic oligonucleotide
cccaggaattcctgtgcatga

SEQ ID NO: 3341 - DNA, 21 bp, Artificial Sequence
  Description of Artificial Sequence: Synthetic oligonucleotide
ccaggaattcctgtgcatgaa

SEQ ID NO: 3342 - DNA, 21 bp, Artificial Sequence
  Description of Artificial Sequence: Synthetic oligonucleotide
caggaattcctgtgcatgaaa

SEQ ID NO: 3343 - DNA, 21 bp, Artificial Sequence
  Description of Artificial Sequence: Synthetic oligonucleotide
aggaattcctgtgcatgaaag

SEQ ID NO: 3344 - DNA, 21 bp, Artificial Sequence
  Description of Artificial Sequence: Synthetic oligonucleotide
ggaattcctgtgcatgaaagc

SEQ ID NO: 3345 - DNA, 21 bp, Artificial Sequence
  Description of Artificial Sequence: Synthetic oligonucleotide
gaattcctgtgcatgaaagca

SEQ ID NO: 3346 - DNA, 21 bp, Artificial Sequence
  Description of Artificial Sequence: Synthetic oligonucleotide
aattcctgtgcatgaaagcac

SEQ ID NO: 3347 - DNA, 21 bp, Artificial Sequence
  Description of Artificial Sequence: Synthetic oligonucleotide
attcctgtgcatgaaagcact

SEQ ID NO: 3348 - DNA, 21 bp, Artificial Sequence
  Description of Artificial Sequence: Synthetic oligonucleotide
ttcctgtgcatgaaagcactg

SEQ ID NO: 3349 - DNA, 21 bp, Artificial Sequence
  Description of Artificial Sequence: Synthetic oligonucleotide
tcctgtgcatgaaagcactgc

SEQ ID NO: 3350 - DNA, 21 bp, Artificial Sequence
  Description of Artificial Sequence: Synthetic oligonucleotide
cctgtgcatgaaagcactgct

SEQ ID NO: 3351 - DNA, 21 bp, Artificial Sequence
  Description of Artificial Sequence: Synthetic oligonucleotide
tactcttcagcattattccag

SEQ ID NO: 3352 - DNA, 21 bp, Artificial Sequence
  Description of Artificial Sequence: Synthetic oligonucleotide
actcttcagcattattccagt

SEQ ID NO: 3353 - DNA, 21 bp, Artificial Sequence
  Description of Artificial Sequence: Synthetic oligonucleotide
ctcttcagcattattccagtg

SEQ ID NO: 3354 - DNA, 21 bp, Artificial Sequence
  Description of Artificial Sequence: Synthetic oligonucleotide
tcttcagcattattccagtgg

SEQ ID NO: 3355 - DNA, 21 bp, Artificial Sequence
  Description of Artificial Sequence: Synthetic oligonucleotide
cttcagcattattccagtgga

SEQ ID NO: 3356 - DNA, 21 bp, Artificial Sequence
  Description of Artificial Sequence: Synthetic oligonucleotide
ttcagcattattccagtggat

SEQ ID NO: 3357 - DNA, 21 bp, Artificial Sequence
  Description of Artificial Sequence: Synthetic oligonucleotide
tcagcattattccagtggatg

SEQ ID NO: 3358 - DNA, 21 bp, Artificial Sequence
  Description of Artificial Sequence: Synthetic oligonucleotide
cagcattattccagtggatgg

SEQ ID NO: 3359 - DNA, 21 bp, Artificial Sequence
  Description of Artificial Sequence: Synthetic oligonucleotide
agcattattccagtggatggg

SEQ ID NO: 3360 - DNA, 21 bp, Artificial Sequence
  Description of Artificial Sequence: Synthetic oligonucleotide
gcattattccagtggatgggc

SEQ ID NO: 3361 - DNA, 21 bp, Artificial Sequence
  Description of Artificial Sequence: Synthetic oligonucleotide
cattattccagtggatgggct

SEQ ID NO: 3362 - DNA, 21 bp, Artificial Sequence
  Description of Artificial Sequence: Synthetic oligonucleotide
attattccagtggatgggctg

SEQ ID NO: 3363 - DNA, 21 bp, Artificial Sequence
  Description of Artificial Sequence: Synthetic oligonucleotide
ttattccagtggatgggctga

SEQ ID NO: 3364 - DNA, 21 bp, Artificial Sequence
  Description of Artificial Sequence: Synthetic oligonucleotide
tattccagtggatgggctgaa

SEQ ID NO: 3365 - DNA, 21 bp, Artificial Sequence
  Description of Artificial Sequence: Synthetic oligonucleotide
attccagtggatgggctgaaa

SEQ ID NO: 3366 - DNA, 21 bp, Artificial Sequence
  Description of Artificial Sequence: Synthetic oligonucleotide
ttccagtggatgggctgaaaa

SEQ ID NO: 3367 - DNA, 21 bp, Artificial Sequence
  Description of Artificial Sequence: Synthetic oligonucleotide
tccagtggatgggctgaaaaa

SEQ ID NO: 3368 - DNA, 21 bp, Artificial Sequence
  Description of Artificial Sequence: Synthetic oligonucleotide
ccagtggatgggctgaaaaat

SEQ ID NO: 3369 - DNA, 21 bp, Artificial Sequence
  Description of Artificial Sequence: Synthetic oligonucleotide
cagtggatgggctgaaaaatc

SEQ ID NO: 3370 - DNA, 21 bp, Artificial Sequence
  Description of Artificial Sequence: Synthetic oligonucleotide
agtggatgggctgaaaaatca

SEQ ID NO: 3371 - DNA, 21 bp, Artificial Sequence
  Description of Artificial Sequence: Synthetic oligonucleotide
gtggatgggctgaaaaatcaa

SEQ ID NO: 3372 - DNA, 21 bp, Artificial Sequence
  Description of Artificial Sequence: Synthetic oligonucleotide
tggatgggctgaaaaatcaaa

SEQ ID NO: 3373 - DNA, 21 bp, Artificial Sequence
  Description of Artificial Sequence: Synthetic oligonucleotide
ggatgggctgaaaaatcaaaa

SEQ ID NO: 3374 - DNA, 21 bp, Artificial Sequence
  Description of Artificial Sequence: Synthetic oligonucleotide
gatgggctgaaaaatcaaaaa

SEQ ID NO: 3375 - DNA, 21 bp, Artificial Sequence
  Description of Artificial Sequence: Synthetic oligonucleotide
atgggctgaaaaatcaaaaat

SEQ ID NO: 3376 - DNA, 21 bp, Artificial Sequence
  Description of Artificial Sequence: Synthetic oligonucleotide
tgggctgaaaaatcaaaaatt

SEQ ID NO: 3377 - DNA, 21 bp, Artificial Sequence
  Description of Artificial Sequence: Synthetic oligonucleotide
gggctgaaaaatcaaaaattc

SEQ ID NO: 3378 - DNA, 21 bp, Artificial Sequence
  Description of Artificial Sequence: Synthetic oligonucleotide
ggctgaaaaatcaaaaattct

SEQ ID NO: 3379 - DNA, 21 bp, Artificial Sequence
  Description of Artificial Sequence: Synthetic oligonucleotide
gctgaaaaatcaaaaattctt

SEQ ID NO: 3380 - DNA, 21 bp, Artificial Sequence
  Description of Artificial Sequence: Synthetic oligonucleotide
ctgaaaaatcaaaaattcttt

SEQ ID NO: 3381 - DNA, 21 bp, Artificial Sequence
  Description of Artificial Sequence: Synthetic oligonucleotide
tgaaaaatcaaaaattctttg

SEQ ID NO: 3382 - DNA, 21 bp, Artificial Sequence
  Description of Artificial Sequence: Synthetic oligonucleotide
aaaaatcaaaaattctttgat

SEQ ID NO: 3383 - DNA, 21 bp, Artificial Sequence
  Description of Artificial Sequence: Synthetic oligonucleotide
aaaatcaaaaattctttgatg

SEQ ID NO: 3384 - DNA, 21 bp, Artificial Sequence
  Description of Artificial Sequence: Synthetic oligonucleotide
aaatcaaaaattctttgatga

SEQ ID NO: 3385 - DNA, 21 bp, Artificial Sequence
  Description of Artificial Sequence: Synthetic oligonucleotide
aatcaaaaattctttgatgaa

SEQ ID NO: 3386 - DNA, 21 bp, Artificial Sequence
  Description of Artificial Sequence: Synthetic oligonucleotide
atcaaaaattctttgatgaac

SEQ ID NO: 3387 - DNA, 21 bp, Artificial Sequence
  Description of Artificial Sequence: Synthetic oligonucleotide
tcaaaaattctttgatgaact

SEQ ID NO: 3388 - DNA, 21 bp, Artificial Sequence
  Description of Artificial Sequence: Synthetic oligonucleotide
caaaaattctttgatgaactt

SEQ ID NO: 3389 - DNA, 21 bp, Artificial Sequence
  Description of Artificial Sequence: Synthetic oligonucleotide
aaaaattctttgatgaacttc

SEQ ID NO: 3390 - DNA, 21 bp, Artificial Sequence
  Description of Artificial Sequence: Synthetic oligonucleotide
aaaattctttgatgaacttcg

SEQ ID NO: 3391 - DNA, 21 bp, Artificial Sequence
  Description of Artificial Sequence: Synthetic oligonucleotide
aaattctttgatgaacttcga

SEQ ID NO: 3392 - DNA, 21 bp, Artificial Sequence
  Description of Artificial Sequence: Synthetic oligonucleotide
aattctttgatgaacttcgaa

SEQ ID NO: 3393 - DNA, 21 bp, Artificial Sequence
  Description of Artificial Sequence: Synthetic oligonucleotide
attctttgatgaacttcgaat

SEQ ID NO: 3394 - DNA, 21 bp, Artificial Sequence
  Description of Artificial Sequence: Synthetic oligonucleotide
ttctttgatgaacttcgaatg

SEQ ID NO: 3395 - DNA, 21 bp, Artificial Sequence
  Description of Artificial Sequence: Synthetic oligonucleotide
tctttgatgaacttcgaatga

SEQ ID NO: 3396 - DNA, 21 bp, Artificial Sequence
  Description of Artificial Sequence: Synthetic oligonucleotide
ctttgatgaacttcgaatgaa

SEQ ID NO: 3397 - DNA, 21 bp, Artificial Sequence
  Description of Artificial Sequence: Synthetic oligonucleotide
tttgatgaacttcgaatgaac

SEQ ID NO: 3398 - DNA, 21 bp, Artificial Sequence
  Description of Artificial Sequence: Synthetic oligonucleotide
ttgatgaacttcgaatgaact

SEQ ID NO: 3399 - DNA, 21 bp, Artificial Sequence
  Description of Artificial Sequence: Synthetic oligonucleotide
tgatgaacttcgaatgaacta

SEQ ID NO: 3400 - DNA, 21 bp, Artificial Sequence
  Description of Artificial Sequence: Synthetic oligonucleotide
gatgaacttcgaatgaactac

SEQ ID NO: 3401 - DNA, 21 bp, Artificial Sequence
  Description of Artificial Sequence: Synthetic oligonucleotide
atgaacttcgaatgaactaca

SEQ ID NO: 3402 - DNA, 21 bp, Artificial Sequence
  Description of Artificial Sequence: Synthetic oligonucleotide
tgaacttcgaatgaactacat

SEQ ID NO: 3403 - DNA, 21 bp, Artificial Sequence
  Description of Artificial Sequence: Synthetic oligonucleotide
gaacttcgaatgaactacatc

SEQ ID NO: 3404 - DNA, 21 bp, Artificial Sequence
  Description of Artificial Sequence: Synthetic oligonucleotide
aacttcgaatgaactacatca

SEQ ID NO: 3405 - DNA, 21 bp, Artificial Sequence
  Description of Artificial Sequence: Synthetic oligonucleotide
acttcgaatgaactacatcaa

SEQ ID NO: 3406 - DNA, 21 bp, Artificial Sequence
  Description of Artificial Sequence: Synthetic oligonucleotide
cttcgaatgaactacatcaag

SEQ ID NO: 3407 - DNA, 21 bp, Artificial Sequence
  Description of Artificial Sequence: Synthetic oligonucleotide
ttcgaatgaactacatcaagg

SEQ ID NO: 3408 - DNA, 21 bp, Artificial Sequence
  Description of Artificial Sequence: Synthetic oligonucleotide
tcgaatgaactacatcaagga

SEQ ID NO: 3409 - DNA, 21 bp, Artificial Sequence
  Description of Artificial Sequence: Synthetic oligonucleotide
cgaatgaactacatcaaggaa

SEQ ID NO: 3410 - DNA, 21 bp, Artificial Sequence
  Description of Artificial Sequence: Synthetic oligonucleotide
gaatgaactacatcaaggaac

SEQ ID NO: 3411 - DNA, 21 bp, Artificial Sequence
  Description of Artificial Sequence: Synthetic oligonucleotide
aatgaactacatcaaggaact

SEQ ID NO: 3412 - DNA, 21 bp, Artificial Sequence
  Description of Artificial Sequence: Synthetic oligonucleotide
atgaactacatcaaggaactc

SEQ ID NO: 3413 - DNA, 21 bp, Artificial Sequence
  Description of Artificial Sequence: Synthetic oligonucleotide
tgaactacatcaaggaactcg

SEQ ID NO: 3414 - DNA, 21 bp, Artificial Sequence
  Description of Artificial Sequence: Synthetic oligonucleotide
gaactacatcaaggaactcga

SEQ ID NO: 3415 - DNA, 21 bp, Artificial Sequence
  Description of Artificial Sequence: Synthetic oligonucleotide
aactacatcaaggaactcgat

SEQ ID NO: 3416 - DNA, 21 bp, Artificial Sequence
  Description of Artificial Sequence: Synthetic oligonucleotide
actacatcaaggaactcgatc

SEQ ID NO: 3417 - DNA, 21 bp, Artificial Sequence
  Description of Artificial Sequence: Synthetic oligonucleotide
ctacatcaaggaactcgatcg

SEQ ID NO: 3418 - DNA, 21 bp, Artificial Sequence
  Description of Artificial Sequence: Synthetic oligonucleotide
gtatcattgcatgcaaaagaa

SEQ ID NO: 3419 - DNA, 21 bp, Artificial Sequence
  Description of Artificial Sequence: Synthetic oligonucleotide
tatcattgcatgcaaaagaaa

SEQ ID NO: 3420 - DNA, 21 bp, Artificial Sequence
  Description of Artificial Sequence: Synthetic oligonucleotide
aaaatcccacatcctgctcaa

SEQ ID NO: 3421 - DNA, 21 bp, Artificial Sequence
  Description of Artificial Sequence: Synthetic oligonucleotide
aaatcccacatcctgctcaag

SEQ ID NO: 3422 - DNA, 21 bp, Artificial Sequence
  Description of Artificial Sequence: Synthetic oligonucleotide
gacgcttctaccagctcacca

SEQ ID NO: 3423 - DNA, 21 bp, Artificial Sequence
  Description of Artificial Sequence: Synthetic oligonucleotide
acgcttctaccagctcaccaa

SEQ ID NO: 3424 - DNA, 21 bp, Artificial Sequence
  Description of Artificial Sequence: Synthetic oligonucleotide
cgcttctaccagctcaccaag

SEQ ID NO: 3425 - DNA, 21 bp, Artificial Sequence
  Description of Artificial Sequence: Synthetic oligonucleotide
gcttctaccagctcaccaagc

SEQ ID NO: 3426 - DNA, 21 bp, Artificial Sequence
  Description of Artificial Sequence: Synthetic oligonucleotide
cttctaccagctcaccaagct

SEQ ID NO: 3427 - DNA, 21 bp, Artificial Sequence
  Description of Artificial Sequence: Synthetic oligonucleotide
ttctaccagctcaccaagctc

SEQ ID NO: 3428 - DNA, 21 bp, Artificial Sequence
  Description of Artificial Sequence: Synthetic oligonucleotide
tctaccagctcaccaagctcc

SEQ ID NO: 3429 - DNA, 21 bp, Artificial Sequence
  Description of Artificial Sequence: Synthetic oligonucleotide
ctaccagctcaccaagctcct

SEQ ID NO: 3430 - DNA, 21 bp, Artificial Sequence
  Description of Artificial Sequence: Synthetic oligonucleotide
taccagctcaccaagctcctg

SEQ ID NO: 3431 - DNA, 21 bp, Artificial Sequence
  Description of Artificial Sequence: Synthetic oligonucleotide
accagctcaccaagctcctgg

SEQ ID NO: 3432 - DNA, 21 bp, Artificial Sequence
  Description of Artificial Sequence: Synthetic oligonucleotide
ccagctcaccaagctcctgga

SEQ ID NO: 3433 - DNA, 21 bp, Artificial Sequence
  Description of Artificial Sequence: Synthetic oligonucleotide
agctcaccaagctcctggact

SEQ ID NO: 3434 - DNA, 21 bp, Artificial Sequence
  Description of Artificial Sequence: Synthetic oligonucleotide
agctcctggactccgtgcagc

SEQ ID NO: 3435 - DNA, 21 bp, Artificial Sequence
  Description of Artificial Sequence: Synthetic oligonucleotide
tccgtgcagcctattgcgaga

SEQ ID NO: 3436 - DNA, 21 bp, Artificial Sequence
  Description of Artificial Sequence: Synthetic oligonucleotide
cgagagagctgcatcagttca

SEQ ID NO: 3437 - DNA, 21 bp, Artificial Sequence
  Description of Artificial Sequence: Synthetic oligonucleotide
gagagagctgcatcagttcac

SEQ ID NO: 3438 - DNA, 21 bp, Artificial Sequence
  Description of Artificial Sequence: Synthetic oligonucleotide
agagagctgcatcagttcact

SEQ ID NO: 3439 - DNA, 21 bp, Artificial Sequence
  Description of Artificial Sequence: Synthetic oligonucleotide
gagagctgcatcagttcactt

SEQ ID NO: 3440 - DNA, 21 bp, Artificial Sequence
  Description of Artificial Sequence: Synthetic oligonucleotide
agagctgcatcagttcacttt

SEQ ID NO: 3441 - DNA, 21 bp, Artificial Sequence
  Description of Artificial Sequence: Synthetic oligonucleotide
gagctgcatcagttcactttt

SEQ ID NO: 3442 - DNA, 21 bp, Artificial Sequence
  Description of Artificial Sequence: Synthetic oligonucleotide
agctgcatcagttcacttttg

SEQ ID NO: 3443 - DNA, 21 bp, Artificial Sequence
  Description of Artificial Sequence: Synthetic oligonucleotide
gctgcatcagttcacttttga

SEQ ID NO: 3444 - DNA, 21 bp, Artificial Sequence
  Description of Artificial Sequence: Synthetic oligonucleotide
ctgcatcagttcacttttgac

SEQ ID NO: 3445 - DNA, 21 bp, Artificial Sequence
  Description of Artificial Sequence: Synthetic oligonucleotide
tgcatcagttcacttttgacc

SEQ ID NO: 3446 - DNA, 21 bp, Artificial Sequence
  Description of Artificial Sequence: Synthetic oligonucleotide
gcatcagttcacttttgacct

SEQ ID NO: 3447 - DNA, 21 bp, Artificial Sequence
  Description of Artificial Sequence: Synthetic oligonucleotide
catcagttcacttttgacctg

SEQ ID NO: 3448 - DNA, 21 bp, Artificial Sequence
  Description of Artificial Sequence: Synthetic oligonucleotide
atcagttcacttttgacctgc

SEQ ID NO: 3449 - DNA, 21 bp, Artificial Sequence
  Description of Artificial Sequence: Synthetic oligonucleotide
tcagttcacttttgacctgct

SEQ ID NO: 3450 - DNA, 21 bp, Artificial Sequence
  Description of Artificial Sequence: Synthetic oligonucleotide
cagttcacttttgacctgcta

SEQ ID NO: 3451 - DNA, 21 bp, Artificial Sequence
  Description of Artificial Sequence: Synthetic oligonucleotide
agttcacttttgacctgctaa

SEQ ID NO: 3452 - DNA, 21 bp, Artificial Sequence
  Description of Artificial Sequence: Synthetic oligonucleotide
gttcacttttgacctgctaat

SEQ ID NO: 3453 - DNA, 21 bp, Artificial Sequence
  Description of Artificial Sequence: Synthetic oligonucleotide
ttcacttttgacctgctaatc

SEQ ID NO: 3454 - DNA, 21 bp, Artificial Sequence
  Description of Artificial Sequence: Synthetic oligonucleotide
tcacttttgacctgctaatca

SEQ ID NO: 3455 - DNA, 21 bp, Artificial Sequence
  Description of Artificial Sequence: Synthetic oligonucleotide
cacttttgacctgctaatcaa

SEQ ID NO: 3456 - DNA, 21 bp, Artificial Sequence
  Description of Artificial Sequence: Synthetic oligonucleotide
acttttgacctgctaatcaag

SEQ ID NO: 3457 - DNA, 21 bp, Artificial Sequence
  Description of Artificial Sequence: Synthetic oligonucleotide
acatggtgagcgtggactttc

SEQ ID NO: 3458 - DNA, 21 bp, Artificial Sequence
  Description of Artificial Sequence: Synthetic oligonucleotide
catggtgagcgtggactttcc

SEQ ID NO: 3459 - DNA, 21 bp, Artificial Sequence
  Description of Artificial Sequence: Synthetic oligonucleotide
cggaaatgatggcagagatca

SEQ ID NO: 3460 - DNA, 21 bp, Artificial Sequence
  Description of Artificial Sequence: Synthetic oligonucleotide
ggaaatgatggcagagatcat

SEQ ID NO: 3461 - DNA, 21 bp, Artificial Sequence
  Description of Artificial Sequence: Synthetic oligonucleotide
gaaatgatggcagagatcatc

SEQ ID NO: 3462 - DNA, 21 bp, Artificial Sequence
  Description of Artificial Sequence: Synthetic oligonucleotide
aaatgatggcagagatcatct

SEQ ID NO: 3463 - DNA, 21 bp, Artificial Sequence
  Description of Artificial Sequence: Synthetic oligonucleotide
aatgatggcagagatcatctc

SEQ ID NO: 3464 - DNA, 21 bp, Artificial Sequence
  Description of Artificial Sequence: Synthetic oligonucleotide
atgatggcagagatcatctct

SEQ ID NO: 3465 - DNA, 21 bp, Artificial Sequence
  Description of Artificial Sequence: Synthetic oligonucleotide
tgatggcagagatcatctctg

SEQ ID NO: 3466 - DNA, 21 bp, Artificial Sequence
  Description of Artificial Sequence: Synthetic oligonucleotide
gatggcagagatcatctctgt

SEQ ID NO: 3467 - DNA, 21 bp, Artificial Sequence
  Description of Artificial Sequence: Synthetic oligonucleotide
atggcagagatcatctctgtg

SEQ ID NO: 3468 - DNA, 21 bp, Artificial Sequence
  Description of Artificial Sequence: Synthetic oligonucleotide
tggcagagatcatctctgtgc

SEQ ID NO: 3469 - DNA, 21 bp, Artificial Sequence
  Description of Artificial Sequence: Synthetic oligonucleotide
ggcagagatcatctctgtgca

SEQ ID NO: 3470 - DNA, 21 bp, Artificial Sequence
  Description of Artificial Sequence: Synthetic oligonucleotide
gcagagatcatctctgtgcaa

SEQ ID NO: 3471 - DNA, 21 bp, Artificial Sequence
  Description of Artificial Sequence: Synthetic oligonucleotide
cagagatcatctctgtgcaag

SEQ ID NO: 3472 - DNA, 21 bp, Artificial Sequence
  Description of Artificial Sequence: Synthetic oligonucleotide
agagatcatctctgtgcaagt

SEQ ID NO: 3473 - DNA, 21 bp, Artificial Sequence
  Description of Artificial Sequence: Synthetic oligonucleotide
gagatcatctctgtgcaagtg

SEQ ID NO: 3474 - DNA, 21 bp, Artificial Sequence
  Description of Artificial Sequence: Synthetic oligonucleotide
agatcatctctgtgcaagtgc

SEQ ID NO: 3475 - DNA, 21 bp, Artificial Sequence
  Description of Artificial Sequence: Synthetic oligonucleotide
gatcatctctgtgcaagtgcc

SEQ ID NO: 3476 - DNA, 21 bp, Artificial Sequence
  Description of Artificial Sequence: Synthetic oligonucleotide
atcatctctgtgcaagtgccc

SEQ ID NO: 3477 - DNA, 21 bp, Artificial Sequence
  Description of Artificial Sequence: Synthetic oligonucleotide
tcatctctgtgcaagtgccca

SEQ ID NO: 3478 - DNA, 21 bp, Artificial Sequence
  Description of Artificial Sequence: Synthetic oligonucleotide
catctctgtgcaagtgcccaa

SEQ ID NO: 3479 - DNA, 21 bp, Artificial Sequence
  Description of Artificial Sequence: Synthetic oligonucleotide
atctctgtgcaagtgcccaag

SEQ ID NO: 3480 - DNA, 21 bp, Artificial Sequence
  Description of Artificial Sequence: Synthetic oligonucleotide
tctctgtgcaagtgcccaaga

SEQ ID NO: 3481 - DNA, 21 bp, Artificial Sequence
  Description of Artificial Sequence: Synthetic oligonucleotide
ctctgtgcaagtgcccaagat

SEQ ID NO: 3482 - DNA, 21 bp, Artificial Sequence
  Description of Artificial Sequence: Synthetic oligonucleotide
tctgtgcaagtgcccaagatc

SEQ ID NO: 3483 - DNA, 21 bp, Artificial Sequence
  Description of Artificial Sequence: Synthetic oligonucleotide
ctgtgcaagtgcccaagatcc

SEQ ID NO: 3484 - DNA, 21 bp, Artificial Sequence
  Description of Artificial Sequence: Synthetic oligonucleotide
tgtgcaagtgcccaagatcct

SEQ ID NO: 3485 - DNA, 21 bp, Artificial Sequence
  Description of Artificial Sequence: Synthetic oligonucleotide
gtgcaagtgcccaagatcctt

SEQ ID NO: 3486 - DNA, 21 bp, Artificial Sequence
  Description of Artificial Sequence: Synthetic oligonucleotide
tgcaagtgcccaagatccttt

SEQ ID NO: 3487 - DNA, 21 bp, Artificial Sequence
  Description of Artificial Sequence: Synthetic oligonucleotide
gcaagtgcccaagatcctttc

SEQ ID NO: 3488 - DNA, 21 bp, Artificial Sequence
  Description of Artificial Sequence: Synthetic oligonucleotide
caagtgcccaagatcctttct

SEQ ID NO: 3489 - DNA, 21 bp, Artificial Sequence
  Description of Artificial Sequence: Synthetic oligonucleotide
aagtgcccaagatcctttctg

SEQ ID NO: 3490 - DNA, 21 bp, Artificial Sequence
  Description of Artificial Sequence: Synthetic oligonucleotide
agtgcccaagatcctttctgg

SEQ ID NO: 3491 - DNA, 21 bp, Artificial Sequence
  Description of Artificial Sequence: Synthetic oligonucleotide
gtgcccaagatcctttctggg

SEQ ID NO: 3492 - DNA, 21 bp, Artificial Sequence
  Description of Artificial Sequence: Synthetic oligonucleotide
tgcccaagatcctttctggga

SEQ ID NO: 3493 - DNA, 21 bp, Artificial Sequence
  Description of Artificial Sequence: Synthetic oligonucleotide
gcccaagatcctttctgggaa

SEQ ID NO: 3494 - DNA, 21 bp, Artificial Sequence
  Description of Artificial Sequence: Synthetic oligonucleotide
cccaagatcctttctgggaaa

SEQ ID NO: 3495 - DNA, 21 bp, Artificial Sequence
  Description of Artificial Sequence: Synthetic oligonucleotide
ccaagatcctttctgggaaag

SEQ ID NO: 3496 - DNA, 21 bp, Artificial Sequence
  Description of Artificial Sequence: Synthetic oligonucleotide
caagatcctttctgggaaagt

SEQ ID NO: 3497 - DNA, 21 bp, Artificial Sequence
  Description of Artificial Sequence: Synthetic oligonucleotide
aagatcctttctgggaaagtc

SEQ ID NO: 3498 - DNA, 21 bp, Artificial Sequence
  Description of Artificial Sequence: Synthetic oligonucleotide
agatcctttctgggaaagtca

SEQ ID NO: 3499 - DNA, 21 bp, Artificial Sequence
  Description of Artificial Sequence: Synthetic oligonucleotide
gatcctttctgggaaagtcaa

SEQ ID NO: 3500 - DNA, 21 bp, Artificial Sequence
  Description of Artificial Sequence: Synthetic oligonucleotide
atcctttctgggaaagtcaag

SEQ ID NO: 3501 - DNA, 21 bp, Artificial Sequence
  Description of Artificial Sequence: Synthetic oligonucleotide
tcctttctgggaaagtcaagc

SEQ ID NO: 3502 - DNA, 21 bp, Artificial Sequence
  Description of Artificial Sequence: Synthetic oligonucleotide
cctttctgggaaagtcaagcc

SEQ ID NO: 3503 - DNA, 21 bp, Artificial Sequence
  Description of Artificial Sequence: Synthetic oligonucleotide
ctttctgggaaagtcaagccc

SEQ ID NO: 3504 - DNA, 21 bp, Artificial Sequence
  Description of Artificial Sequence: Synthetic oligonucleotide
tttctgggaaagtcaagccca

SEQ ID NO: 3505 - DNA, 21 bp, Artificial Sequence
  Description of Artificial Sequence: Synthetic oligonucleotide
ttctgggaaagtcaagcccat

SEQ ID NO: 3506 - DNA, 21 bp, Artificial Sequence
  Description of Artificial Sequence: Synthetic oligonucleotide
tctgggaaagtcaagcccatc

SEQ ID NO: 3507 - DNA, 21 bp, Artificial Sequence
  Description of Artificial Sequence: Synthetic oligonucleotide
ctgggaaagtcaagcccatct

SEQ ID NO: 3508 - DNA, 21 bp, Artificial Sequence
  Description of Artificial Sequence: Synthetic oligonucleotide
tgggaaagtcaagcccatcta

SEQ ID NO: 3509 - DNA, 21 bp, Artificial Sequence
  Description of Artificial Sequence: Synthetic oligonucleotide
gggaaagtcaagcccatctat

SEQ ID NO: 3510 - DNA, 21 bp, Artificial Sequence
  Description of Artificial Sequence: Synthetic oligonucleotide
ggaaagtcaagcccatctatt

SEQ ID NO: 3511 - DNA, 21 bp, Artificial Sequence
  Description of Artificial Sequence: Synthetic oligonucleotide
gaaagtcaagcccatctattt

SEQ ID NO: 3512 - DNA, 21 bp, Artificial Sequence
  Description of Artificial Sequence: Synthetic oligonucleotide
ttcagatgtcttctgcctgtt

SEQ ID NO: 3513 - DNA, 21 bp, Artificial Sequence
  Description of Artificial Sequence: Synthetic oligonucleotide
tcagatgtcttctgcctgtta

SEQ ID NO: 3514 - DNA, 21 bp, Artificial Sequence
  Description of Artificial Sequence: Synthetic oligonucleotide
cagatgtcttctgcctgttat

SEQ ID NO: 3515 - DNA, 21 bp, Artificial Sequence
  Description of Artificial Sequence: Synthetic oligonucleotide
agatgtcttctgcctgttata

SEQ ID NO: 3516 - DNA, 21 bp, Artificial Sequence
  Description of Artificial Sequence: Synthetic oligonucleotide
ggggaatttcctctattgatg

SEQ ID NO: 3517 - DNA, 21 bp, Artificial Sequence
  Description of Artificial Sequence: Synthetic oligonucleotide
ttgctgggctttttttttctc

SEQ ID NO: 3518 - DNA, 21 bp, Artificial Sequence
  Description of Artificial Sequence: Synthetic oligonucleotide
tgctgggctttttttttctct

SEQ ID NO: 3519 - DNA, 21 bp, Artificial Sequence
  Description of Artificial Sequence: Synthetic oligonucleotide
gctttttttttctctttctct

SEQ ID NO: 3520 - DNA, 21 bp, Artificial Sequence
  Description of Artificial Sequence: Synthetic oligonucleotide
ttttttctctttctctccttt

SEQ ID NO: 3521 - DNA, 21 bp, Artificial Sequence
  Description of Artificial Sequence: Synthetic oligonucleotide
tctttttcttcttccctccct

SEQ ID NO: 3522 - DNA, 21 bp, Artificial Sequence
  Description of Artificial Sequence: Synthetic oligonucleotide
tgttgtatgcctttaaatctg

SEQ ID NO: 3523 - DNA, 21 bp, Artificial Sequence
  Description of Artificial Sequence: Synthetic oligonucleotide
tgtgcttgtttacagcactac

SEQ ID NO: 3524 - DNA, 21 bp, Artificial Sequence
  Description of Artificial Sequence: Synthetic oligonucleotide
ttagagagctaagattatctg

SEQ ID NO: 3525 - DNA, 21 bp, Artificial Sequence
  Description of Artificial Sequence: Synthetic oligonucleotide
ggggaaatcaaaacaaaaaca

SEQ ID NO: 3526 - DNA, 25 bp, Artificial Sequence
  Description of Artificial Sequence: Synthetic oligonucleotide
  Description of Combined DNA/RNA Molecule: Synthetic oligonucleotide
cagcagcacacugaggaugguuctc

SEQ ID NO: 3527 - DNA, 25 bp, Artificial Sequence
  Description of Artificial Sequence: Synthetic oligonucleotide
  Description of Combined DNA/RNA Molecule: Synthetic oligonucleotide
ccgagggccacccugagagcagctg

SEQ ID NO: 3528 - DNA, 25 bp, Artificial Sequence
  Description of Artificial Sequence: Synthetic oligonucleotide
  Description of Combined DNA/RNA Molecule: Synthetic oligonucleotide
gccacccugagagcagcugccuccc

SEQ ID NO: 3529 - DNA, 25 bp, Artificial Sequence
  Description of Artificial Sequence: Synthetic oligonucleotide
  Description of Combined DNA/RNA Molecule: Synthetic oligonucleotide
cugccgcagcagccaccagcucctc

SEQ ID NO: 3530 - DNA, 25 bp, Artificial Sequence
  Description of Artificial Sequence: Synthetic oligonucleotide
  Description of Combined DNA/RNA Molecule: Synthetic oligonucleotide
cuuucccaggcuuaagcagcugctc

SEQ ID NO: 3531 - DNA, 25 bp, Artificial Sequence
  Description of Artificial Sequence: Synthetic oligonucleotide
  Description of Combined DNA/RNA Molecule: Synthetic oligonucleotide
gcaacuucuucagcagcagcaacaa

SEQ ID NO: 3532 - DNA, 25 bp, Artificial Sequence
  Description of Artificial Sequence: Synthetic oligonucleotide
  Description of Combined DNA/RNA Molecule: Synthetic oligonucleotide
gcgucccacuccuugugcgccgctg

SEQ ID NO: 3533 - DNA, 25 bp, Artificial Sequence
  Description of Artificial Sequence: Synthetic oligonucleotide
  Description of Combined DNA/RNA Molecule: Synthetic oligonucleotide
ggcagcagugaagcagguagcuctg

SEQ ID NO: 3534 - DNA, 25 bp, Artificial Sequence
  Description of Artificial Sequence: Synthetic oligonucleotide
  Description of Combined DNA/RNA Molecule: Synthetic oligonucleotide
uccgcuggcucuguccgggccgccg

SEQ ID NO: 3535 - DNA, 25 bp, Artificial Sequence
  Description of Artificial Sequence: Synthetic oligonucleotide
  Description of Combined DNA/RNA Molecule: Synthetic oligonucleotide
agcgccugggcugcggcggcagcgc

SEQ ID NO: 3536 - DNA, 25 bp, Artificial Sequence
  Description of Artificial Sequence: Synthetic oligonucleotide
  Description of Combined DNA/RNA Molecule: Synthetic oligonucleotide
cugggcugcggcggcagcgcaaugc

SEQ ID NO: 3537 - DNA, 25 bp, Artificial Sequence
  Description of Artificial Sequence: Synthetic oligonucleotide
  Description of Combined DNA/RNA Molecule: Synthetic oligonucleotide
gcggcggcagcgcaaugccgcuatg

SEQ ID NO: 3538 - DNA, 25 bp, Artificial Sequence
  Description of Artificial Sequence: Synthetic oligonucleotide
  Description of Combined DNA/RNA Molecule: Synthetic oligonucleotide
uagccgggcccagcacuggaucgcc

SEQ ID NO: 3539 - DNA, 25 bp, Artificial Sequence
  Description of Artificial Sequence: Synthetic oligonucleotide
  Description of Combined DNA/RNA Molecule: Synthetic oligonucleotide
uccuggcauacucucuucacagctg

SEQ ID NO: 3540 - DNA, 25 bp, Artificial Sequence
  Description of Artificial Sequence: Synthetic oligonucleotide
  Description of Combined DNA/RNA Molecule: Synthetic oligonucleotide
cagcccaagcgaugccgggccugta

SEQ ID NO: 3541 - DNA, 25 bp, Artificial Sequence
  Description of Artificial Sequence: Synthetic oligonucleotide
  Description of Combined DNA/RNA Molecule: Synthetic oligonucleotide
uucuggcugucacuacggagcuctc

SEQ ID NO: 3542 - DNA, 25 bp, Artificial Sequence
  Description of Artificial Sequence: Synthetic oligonucleotide
  Description of Combined DNA/RNA Molecule: Synthetic oligonucleotide
gagcucucacuuguggcagcugcaa

SEQ ID NO: 3543 - DNA, 25 bp, Artificial Sequence
  Description of Artificial Sequence: Synthetic oligonucleotide
  Description of Combined DNA/RNA Molecule: Synthetic oligonucleotide
cuuguggcagcugcaaggucuuctt

SEQ ID NO: 3544 - DNA, 25 bp, Artificial Sequence
  Description of Artificial Sequence: Synthetic oligonucleotide
  Description of Combined DNA/RNA Molecule: Synthetic oligonucleotide
ggcagcugcaaggucuucuucaaaa

SEQ ID NO: 3545 - DNA, 25 bp, Artificial Sequence
  Description of Artificial Sequence: Synthetic oligonucleotide
  Description of Combined DNA/RNA Molecule: Synthetic oligonucleotide
gaugacucugggagcucguaagctg

SEQ ID NO: 3546 - DNA, 25 bp, Artificial Sequence
  Description of Artificial Sequence: Synthetic oligonucleotide
  Description of Combined DNA/RNA Molecule: Synthetic oligonucleotide
gggagcucguaagcugaagaaactt

SEQ ID NO: 3547 - DNA, 25 bp, Artificial Sequence
  Description of Artificial Sequence: Synthetic oligonucleotide
  Description of Combined DNA/RNA Molecule: Synthetic oligonucleotide
gauuccuuugcugccuuguuaucta

SEQ ID NO: 3548 - DNA, 25 bp, Artificial Sequence
  Description of Artificial Sequence: Synthetic oligonucleotide
  Description of Combined DNA/RNA Molecule: Synthetic oligonucleotide
uugcugccuuguuaucuagccucaa

SEQ ID NO: 3549 - DNA, 25 bp, Artificial Sequence
  Description of Artificial Sequence: Synthetic oligonucleotide
  Description of Combined DNA/RNA Molecule: Synthetic oligonucleotide
gccuggcuuccgcaacuugcaugtg

SEQ ID NO: 3550 - DNA, 25 bp, Artificial Sequence
  Description of Artificial Sequence: Synthetic oligonucleotide
  Description of Combined DNA/RNA Molecule: Synthetic oligonucleotide
gaugggacugaugguauuugccatg

SEQ ID NO: 3551 - DNA, 25 bp, Artificial Sequence
  Description of Artificial Sequence: Synthetic oligonucleotide
  Description of Combined DNA/RNA Molecule: Synthetic oligonucleotide
ggaugcucuacuuugcaccugactt

SEQ ID NO: 3552 - DNA, 25 bp, Artificial Sequence
  Description of Artificial Sequence: Synthetic oligonucleotide
  Description of Combined DNA/RNA Molecule: Synthetic oligonucleotide
cucuacuuugcaccugacuuggutt

SEQ ID NO: 3553 - DNA, 25 bp, Artificial Sequence
  Description of Artificial Sequence: Synthetic oligonucleotide
  Description of Combined DNA/RNA Molecule: Synthetic oligonucleotide
uugcaccugacuugguuuucaauga

SEQ ID NO: 3554 - DNA, 25 bp, Artificial Sequence
  Description of Artificial Sequence: Synthetic oligonucleotide
  Description of Combined DNA/RNA Molecule: Synthetic oligonucleotide
cuugguuuucaaugaguaccgcatg

SEQ ID NO: 3555 - DNA, 25 bp, Artificial Sequence
  Description of Artificial Sequence: Synthetic oligonucleotide
  Description of Combined DNA/RNA Molecule: Synthetic oligonucleotide
guaccgcaugcacaagucucggatg

SEQ ID NO: 3556 - DNA, 25 bp, Artificial Sequence
  Description of Artificial Sequence: Synthetic oligonucleotide
  Description of Combined DNA/RNA Molecule: Synthetic oligonucleotide
gugcaugaaagcacugcugcucutc

SEQ ID NO: 3557 - DNA, 25 bp, Artificial Sequence
  Description of Artificial Sequence: Synthetic oligonucleotide
  Description of Combined DNA/RNA Molecule: Synthetic oligonucleotide
ugaaagcacugcugcucuucagcat

SEQ ID NO: 3558 - DNA, 25 bp, Artificial Sequence
  Description of Artificial Sequence: Synthetic oligonucleotide
  Description of Combined DNA/RNA Molecule: Synthetic oligonucleotide
cacugcugcucuucagcauuauucc

SEQ ID NO: 3559 - DNA, 25 bp, Artificial Sequence
  Description of Artificial Sequence: Synthetic oligonucleotide
  Description of Combined DNA/RNA Molecule: Synthetic oligonucleotide
cugcucuucagcauuauuccagugg

SEQ ID NO: 3560 - DNA, 25 bp, Artificial Sequence
  Description of Artificial Sequence: Synthetic oligonucleotide
  Description of Combined DNA/RNA Molecule: Synthetic oligonucleotide
cucaccaagcuccuggauucugugc

SEQ ID NO: 3561 - DNA, 25 bp, Artificial Sequence
  Description of Artificial Sequence: Synthetic oligonucleotide
  Description of Combined DNA/RNA Molecule: Synthetic oligonucleotide
cuccuggauucugugcagccuautg

SEQ ID NO: 3562 - DNA, 25 bp, Artificial Sequence
  Description of Artificial Sequence: Synthetic oligonucleotide
  Description of Combined DNA/RNA Molecule: Synthetic oligonucleotide
ggauucugugcagccuauugcaaga

SEQ ID NO: 3563 - DNA, 25 bp, Artificial Sequence
  Description of Artificial Sequence: Synthetic oligonucleotide
  Description of Combined DNA/RNA Molecule: Synthetic oligonucleotide
ugugcagccuauugcaagagagctg

SEQ ID NO: 3564 - DNA, 25 bp, Artificial Sequence
  Description of Artificial Sequence: Synthetic oligonucleotide
  Description of Combined DNA/RNA Molecule: Synthetic oligonucleotide
gccuauugcaagagagcugcaucag

SEQ ID NO: 3565 - DNA, 25 bp, Artificial Sequence
  Description of Artificial Sequence: Synthetic oligonucleotide
  Description of Combined DNA/RNA Molecule: Synthetic oligonucleotide
guggacuuuccugaaaugauggcag

SEQ ID NO: 3566 - DNA, 25 bp, Artificial Sequence
  Description of Artificial Sequence: Synthetic oligonucleotide
  Description of Combined DNA/RNA Molecule: Synthetic oligonucleotide
uucugccuguuauauaacucugcac

SEQ ID NO: 3567 - DNA, 25 bp, Artificial Sequence
  Description of Artificial Sequence: Synthetic oligonucleotide
  Description of Combined DNA/RNA Molecule: Synthetic oligonucleotide
cacuacuucucugcagugccuuggg

SEQ ID NO: 3568 - DNA, 25 bp, Artificial Sequence
  Description of Artificial Sequence: Synthetic oligonucleotide
  Description of Combined DNA/RNA Molecule: Synthetic oligonucleotide
cugggcuucuccuucuuuuuuuutc

SEQ ID NO: 3569 - DNA, 25 bp, Artificial Sequence
  Description of Artificial Sequence: Synthetic oligonucleotide
  Description of Combined DNA/RNA Molecule: Synthetic oligonucleotide
uucuccuucuuuuuuuuucuucutc

SEQ ID NO: 3570 - DNA, 25 bp, Artificial Sequence
  Description of Artificial Sequence: Synthetic oligonucleotide
  Description of Combined DNA/RNA Molecule: Synthetic oligonucleotide
cuuuuuuuuucuucuucccuccctc

SEQ ID NO: 3571 - DNA, 25 bp, Artificial Sequence
  Description of Artificial Sequence: Synthetic oligonucleotide
  Description of Combined DNA/RNA Molecule: Synthetic oligonucleotide
gcugcguauuguggcuccugccutt

SEQ ID NO: 3572 - DNA, 25 bp, Artificial Sequence
  Description of Artificial Sequence: Synthetic oligonucleotide
  Description of Combined DNA/RNA Molecule: Synthetic oligonucleotide
uggcuccugccuuuguuuugauutc

SEQ ID NO: 3573 - DNA, 25 bp, Artificial Sequence
  Description of Artificial Sequence: Synthetic oligonucleotide
  Description of Combined DNA/RNA Molecule: Synthetic oligonucleotide
ccugccuuuguuuugauuucugutg

SEQ ID NO: 3574 - RNA, 27 nt, Artificial Sequence
  Description of Artificial Sequence: Synthetic oligonucleotide
gagaaccauccucagugugcugcugcc

SEQ ID NO: 3575 - RNA, 27 nt, Artificial Sequence
  Description of Artificial Sequence: Synthetic oligonucleotide
cagcugcucucaggguggcccucggag

SEQ ID NO: 3576 - RNA, 27 nt, Artificial Sequence
  Description of Artificial Sequence: Synthetic oligonucleotide
gggaggcagcugcucucaggguggccc

SEQ ID NO: 3577 - RNA, 27 nt, Artificial Sequence
  Description of Artificial Sequence: Synthetic oligonucleotide
gaggagcugguggcugcugcggcagcc

SEQ ID NO: 3578 - RNA, 27 nt, Artificial Sequence
  Description of Artificial Sequence: Synthetic oligonucleotide
gagcagcugcuuaagccugggaaagug

SEQ ID NO: 3579 - RNA, 27 nt, Artificial Sequence
  Description of Artificial Sequence: Synthetic oligonucleotide
uuguugcugcugcugaagaaguugcau

SEQ ID NO: 3580 - RNA, 27 nt, Artificial Sequence
  Description of Artificial Sequence: Synthetic oligonucleotide
cagcggcgcacaaggagugggacgcac

SEQ ID NO: 3581 - RNA, 27 nt, Artificial Sequence
  Description of Artificial Sequence: Synthetic oligonucleotide
cagagcuaccugcuucacugcugccag

SEQ ID NO: 3582 - RNA, 27 nt, Artificial Sequence
  Description of Artificial Sequence: Synthetic oligonucleotide
cggcggcccggacagagccagcggaaa

SEQ ID NO: 3583 - RNA, 27 nt, Artificial Sequence
  Description of Artificial Sequence: Synthetic oligonucleotide
gcgcugccgccgcagcccaggcgcugc

SEQ ID NO: 3584 - RNA, 27 nt, Artificial Sequence
  Description of Artificial Sequence: Synthetic oligonucleotide
gcauugcgcugccgccgcagcccaggc

SEQ ID NO: 3585 - RNA, 27 nt, Artificial Sequence
  Description of Artificial Sequence: Synthetic oligonucleotide
cauagcggcauugcgcugccgccgcag

SEQ ID NO: 3586 - RNA, 27 nt, Artificial Sequence
  Description of Artificial Sequence: Synthetic oligonucleotide
ggcgauccagugcugggcccggcuaca

SEQ ID NO: 3587 - RNA, 27 nt, Artificial Sequence
  Description of Artificial Sequence: Synthetic oligonucleotide
cagcugugaagagaguaugccaggaag

SEQ ID NO: 3588 - RNA, 27 nt, Artificial Sequence
  Description of Artificial Sequence: Synthetic oligonucleotide
uacaggcccggcaucgcuugggcugcu

SEQ ID NO: 3589 - RNA, 27 nt, Artificial Sequence
  Description of Artificial Sequence: Synthetic oligonucleotide
gagagcuccguagugacagccagaagc

SEQ ID NO: 3590 - RNA, 27 nt, Artificial Sequence
  Description of Artificial Sequence: Synthetic oligonucleotide
uugcagcugccacaagugagagcuccg

SEQ ID NO: 3591 - RNA, 27 nt, Artificial Sequence
  Description of Artificial Sequence: Synthetic oligonucleotide
aagaagaccuugcagcugccacaagug

SEQ ID NO: 3592 - RNA, 27 nt, Artificial Sequence
  Description of Artificial Sequence: Synthetic oligonucleotide
uuuugaagaagaccuugcagcugccac

SEQ ID NO: 3593 - RNA, 27 nt, Artificial Sequence
  Description of Artificial Sequence: Synthetic oligonucleotide
cagcuuacgagcucccagagucauccc

SEQ ID NO: 3594 - RNA, 27 nt, Artificial Sequence
  Description of Artificial Sequence: Synthetic oligonucleotide
aaguuucuucagcuuacgagcucccag

SEQ ID NO: 3595 - RNA, 27 nt, Artificial Sequence
  Description of Artificial Sequence: Synthetic oligonucleotide
uagauaacaaggcagcaaaggaaucug

SEQ ID NO: 3596 - RNA, 27 nt, Artificial Sequence
  Description of Artificial Sequence: Synthetic oligonucleotide
uugaggcuagauaacaaggcagcaaag

SEQ ID NO: 3597 - RNA, 27 nt, Artificial Sequence
  Description of Artificial Sequence: Synthetic oligonucleotide
cacaugcaaguugcggaagccaggcaa

SEQ ID NO: 3598 - RNA, 27 nt, Artificial Sequence
  Description of Artificial Sequence: Synthetic oligonucleotide
cauggcaaauaccaucagucccaucca

SEQ ID NO: 3599 - RNA, 27 nt, Artificial Sequence
  Description of Artificial Sequence: Synthetic oligonucleotide
aagucaggugcaaaguagagcauccug

SEQ ID NO: 3600 - RNA, 27 nt, Artificial Sequence
  Description of Artificial Sequence: Synthetic oligonucleotide
aaaccaagucaggugcaaaguagagca

SEQ ID NO: 3601 - RNA, 27 nt, Artificial Sequence
  Description of Artificial Sequence: Synthetic oligonucleotide
ucauugaaaaccaagucaggugcaaag

SEQ ID NO: 3602 - RNA, 27 nt, Artificial Sequence
  Description of Artificial Sequence: Synthetic oligonucleotide
caugcgguacucauugaaaaccaaguc

SEQ ID NO: 3603 - RNA, 27 nt, Artificial Sequence
  Description of Artificial Sequence: Synthetic oligonucleotide
cauccgagacuugugcaugcgguacuc

SEQ ID NO: 3604 - RNA, 27 nt, Artificial Sequence
  Description of Artificial Sequence: Synthetic oligonucleotide
gaagagcagcagugcuuucaugcacag

SEQ ID NO: 3605 - RNA, 27 nt, Artificial Sequence
  Description of Artificial Sequence: Synthetic oligonucleotide
augcugaagagcagcagugcuuucaug

SEQ ID NO: 3606 - RNA, 27 nt, Artificial Sequence
  Description of Artificial Sequence: Synthetic oligonucleotide
ggaauaaugcugaagagcagcagugcu

SEQ ID NO: 3607 - RNA, 27 nt, Artificial Sequence
  Description of Artificial Sequence: Synthetic oligonucleotide
ccacuggaauaaugcugaagagcagca

SEQ ID NO: 3608 - RNA, 27 nt, Artificial Sequence
  Description of Artificial Sequence: Synthetic oligonucleotide
gcacagaauccaggagcuuggugagcu

SEQ ID NO: 3609 - RNA, 27 nt, Artificial Sequence
  Description of Artificial Sequence: Synthetic oligonucleotide
caauaggcugcacagaauccaggagcu

SEQ ID NO: 3610 - RNA, 27 nt, Artificial Sequence
  Description of Artificial Sequence: Synthetic oligonucleotide
ucuugcaauaggcugcacagaauccag

SEQ ID NO: 3611 - RNA, 27 nt, Artificial Sequence
  Description of Artificial Sequence: Synthetic oligonucleotide
cagcucucuugcaauaggcugcacaga

SEQ ID NO: 3612 - RNA, 27 nt, Artificial Sequence
  Description of Artificial Sequence: Synthetic oligonucleotide
cugaugcagcucucuugcaauaggcug

SEQ ID NO: 3613 - RNA, 27 nt, Artificial Sequence
  Description of Artificial Sequence: Synthetic oligonucleotide
cugccaucauuucaggaaaguccacgc

SEQ ID NO: 3614 - RNA, 27 nt, Artificial Sequence
  Description of Artificial Sequence: Synthetic oligonucleotide
gugcagaguuauauaacaggcagaaga

SEQ ID NO: 3615 - RNA, 27 nt, Artificial Sequence
  Description of Artificial Sequence: Synthetic oligonucleotide
cccaaggcacugcagagaaguagugca

SEQ ID NO: 3616 - RNA, 27 nt, Artificial Sequence
  Description of Artificial Sequence: Synthetic oligonucleotide
gaaaaaaaaagaaggagaagcccagga

SEQ ID NO: 3617 - RNA, 27 nt, Artificial Sequence
  Description of Artificial Sequence: Synthetic oligonucleotide
gaagaagaaaaaaaaagaaggagaagc

SEQ ID NO: 3618 - RNA, 27 nt, Artificial Sequence
  Description of Artificial Sequence: Synthetic oligonucleotide
gagggagggaagaagaaaaaaaaagaa

SEQ ID NO: 3619 - RNA, 27 nt, Artificial Sequence
  Description of Artificial Sequence: Synthetic oligonucleotide
aaaggcaggagccacaauacgcagcag

SEQ ID NO: 3620 - RNA, 27 nt, Artificial Sequence
  Description of Artificial Sequence: Synthetic oligonucleotide
gaaaucaaaacaaaggcaggagccaca

SEQ ID NO: 3621 - RNA, 27 nt, Artificial Sequence
  Description of Artificial Sequence: Synthetic oligonucleotide
caacagaaaucaaaacaaaggcaggag

SEQ ID NO: 3622 - DNA, 27 bp, Artificial Sequence
  Description of Artificial Sequence: Synthetic oligonucleotide
ggcagcagcacactgaggatggttctc

SEQ ID NO: 3623 - DNA, 27 bp, Artificial Sequence
  Description of Artificial Sequence: Synthetic oligonucleotide
ctccgagggccaccctgagagcagctg

SEQ ID NO: 3624 - DNA, 27 bp, Artificial Sequence
  Description of Artificial Sequence: Synthetic oligonucleotide
gggccaccctgagagcagctgcctccc

SEQ ID NO: 3625 - DNA, 27 bp, Artificial Sequence
  Description of Artificial Sequence: Synthetic oligonucleotide
ggctgccgcagcagccaccagctcctc

SEQ ID NO: 3626 - DNA, 27 bp, Artificial Sequence
  Description of Artificial Sequence: Synthetic oligonucleotide
cactttcccaggcttaagcagctgctc

SEQ ID NO: 3627 - DNA, 27 bp, Artificial Sequence
  Description of Artificial Sequence: Synthetic oligonucleotide
atgcaacttcttcagcagcagcaacaa

SEQ ID NO: 3628 - DNA, 27 bp, Artificial Sequence
  Description of Artificial Sequence: Synthetic oligonucleotide
gtgcgtcccactccttgtgcgccgctg

SEQ ID NO: 3629 - DNA, 27 bp, Artificial Sequence
  Description of Artificial Sequence: Synthetic oligonucleotide
ctggcagcagtgaagcaggtagctctg

SEQ ID NO: 3630 - DNA, 27 bp, Artificial Sequence
  Description of Artificial Sequence: Synthetic oligonucleotide
tttccgctggctctgtccgggccgccg

SEQ ID NO: 3631 - DNA, 27 bp, Artificial Sequence
  Description of Artificial Sequence: Synthetic oligonucleotide
gcagcgcctgggctgcggcggcagcgc

SEQ ID NO: 3632 - DNA, 27 bp, Artificial Sequence
  Description of Artificial Sequence: Synthetic oligonucleotide
gcctgggctgcggcggcagcgcaatgc

SEQ ID NO: 3633 - DNA, 27 bp, Artificial Sequence
  Description of Artificial Sequence: Synthetic oligonucleotide
ctgcggcggcagcgcaatgccgctatg

SEQ ID NO: 3634 - DNA, 27 bp, Artificial Sequence
  Description of Artificial Sequence: Synthetic oligonucleotide
tgtagccgggcccagcactggatcgcc

SEQ ID NO: 3635 - DNA, 27 bp, Artificial Sequence
  Description of Artificial Sequence: Synthetic oligonucleotide
cttcctggcatactctcttcacagctg

SEQ ID NO: 3636 - DNA, 27 bp, Artificial Sequence
  Description of Artificial Sequence: Synthetic oligonucleotide
agcagcccaagcgatgccgggcctgta

SEQ ID NO: 3637 - DNA, 27 bp, Artificial Sequence
  Description of Artificial Sequence: Synthetic oligonucleotide
gcttctggctgtcactacggagctctc

SEQ ID NO: 3638 - DNA, 27 bp, Artificial Sequence
  Description of Artificial Sequence: Synthetic oligonucleotide
cggagctctcacttgtggcagctgcaa

SEQ ID NO: 3639 - DNA, 27 bp, Artificial Sequence
  Description of Artificial Sequence: Synthetic oligonucleotide
cacttgtggcagctgcaaggtcttctt

SEQ ID NO: 3640 - DNA, 27 bp, Artificial Sequence
  Description of Artificial Sequence: Synthetic oligonucleotide
gtggcagctgcaaggtcttcttcaaaa

SEQ ID NO: 3641 - DNA, 27 bp, Artificial Sequence
  Description of Artificial Sequence: Synthetic oligonucleotide
gggatgactctgggagctcgtaagctg

SEQ ID NO: 3642 - DNA, 27 bp, Artificial Sequence
  Description of Artificial Sequence: Synthetic oligonucleotide
ctgggagctcgtaagctgaagaaactt

SEQ ID NO: 3643 - DNA, 27 bp, Artificial Sequence
  Description of Artificial Sequence: Synthetic oligonucleotide
cagattcctttgctgccttgttatcta

SEQ ID NO: 3644 - DNA, 27 bp, Artificial Sequence
  Description of Artificial Sequence: Synthetic oligonucleotide
ctttgctgccttgttatctagcctcaa

SEQ ID NO: 3645 - DNA, 27 bp, Artificial Sequence
  Description of Artificial Sequence: Synthetic oligonucleotide
ttgcctggcttccgcaacttgcatgtg

SEQ ID NO: 3646 - DNA, 27 bp, Artificial Sequence
  Description of Artificial Sequence: Synthetic oligonucleotide
tggatgggactgatggtatttgccatg

SEQ ID NO: 3647 - DNA, 27 bp, Artificial Sequence
  Description of Artificial Sequence: Synthetic oligonucleotide
caggatgctctactttgcacctgactt

SEQ ID NO: 3648 - DNA, 27 bp, Artificial Sequence
  Description of Artificial Sequence: Synthetic oligonucleotide
tgctctactttgcacctgacttggttt

SEQ ID NO: 3649 - DNA, 27 bp, Artificial Sequence
  Description of Artificial Sequence: Synthetic oligonucleotide
ctttgcacctgacttggttttcaatga

SEQ ID NO: 3650 - DNA, 27 bp, Artificial Sequence
  Description of Artificial Sequence: Synthetic oligonucleotide
gacttggttttcaatgagtaccgcatg

SEQ ID NO: 3651 - DNA, 27 bp, Artificial Sequence
  Description of Artificial Sequence: Synthetic oligonucleotide
gagtaccgcatgcacaagtctcggatg

SEQ ID NO: 3652 - DNA, 27 bp, Artificial Sequence
  Description of Artificial Sequence: Synthetic oligonucleotide
ctgtgcatgaaagcactgctgctcttc

SEQ ID NO: 3653 - DNA, 27 bp, Artificial Sequence
  Description of Artificial Sequence: Synthetic oligonucleotide
catgaaagcactgctgctcttcagcat

SEQ ID NO: 3654 - DNA, 27 bp, Artificial Sequence
  Description of Artificial Sequence: Synthetic oligonucleotide
agcactgctgctcttcagcattattcc

SEQ ID NO: 3655 - DNA, 27 bp, Artificial Sequence
  Description of Artificial Sequence: Synthetic oligonucleotide
tgctgctcttcagcattattccagtgg

SEQ ID NO: 3656 - DNA, 27 bp, Artificial Sequence
  Description of Artificial Sequence: Synthetic oligonucleotide
agctcaccaagctcctggattctgtgc

SEQ ID NO: 3657 - DNA, 27 bp, Artificial Sequence
  Description of Artificial Sequence: Synthetic oligonucleotide
agctcctggattctgtgcagcctattg

SEQ ID NO: 3658 - DNA, 27 bp, Artificial Sequence
  Description of Artificial Sequence: Synthetic oligonucleotide
ctggattctgtgcagcctattgcaaga

SEQ ID NO: 3659 - DNA, 27 bp, Artificial Sequence
  Description of Artificial Sequence: Synthetic oligonucleotide
tctgtgcagcctattgcaagagagctg

SEQ ID NO: 3660 - DNA, 27 bp, Artificial Sequence
  Description of Artificial Sequence: Synthetic oligonucleotide
cagcctattgcaagagagctgcatcag

SEQ ID NO: 3661 - DNA, 27 bp, Artificial Sequence
  Description of Artificial Sequence: Synthetic oligonucleotide
gcgtggactttcctgaaatgatggcag

SEQ ID NO: 3662 - DNA, 27 bp, Artificial Sequence
  Description of Artificial Sequence: Synthetic oligonucleotide
tcttctgcctgttatataactctgcac

SEQ ID NO: 3663 - DNA, 27 bp, Artificial Sequence
  Description of Artificial Sequence: Synthetic oligonucleotide
tgcactacttctctgcagtgccttggg

SEQ ID NO: 3664 - DNA, 27 bp, Artificial Sequence
  Description of Artificial Sequence: Synthetic oligonucleotide
tcctgggcttctccttctttttttttc

SEQ ID NO: 3665 - DNA, 27 bp, Artificial Sequence
  Description of Artificial Sequence: Synthetic oligonucleotide
gcttctccttctttttttttcttcttc

SEQ ID NO: 3666 - DNA, 27 bp, Artificial Sequence
  Description of Artificial Sequence: Synthetic oligonucleotide
ttctttttttttcttcttccctccctc

SEQ ID NO: 3667 - DNA, 27 bp, Artificial Sequence
  Description of Artificial Sequence: Synthetic oligonucleotide
ctgctgcgtattgtggctcctgccttt

SEQ ID NO: 3668 - DNA, 27 bp, Artificial Sequence
  Description of Artificial Sequence: Synthetic oligonucleotide
tgtggctcctgcctttgttttgatttc

SEQ ID NO: 3669 - DNA, 27 bp, Artificial Sequence
  Description of Artificial Sequence: Synthetic oligonucleotide
ctcctgcctttgttttgatttctgttg

SEQ ID NO: 3670 - RNA, 25 nt, Artificial Sequence
  Description of Artificial Sequence: Synthetic oligonucleotide
cagcagcacacugaggaugguucuc

SEQ ID NO: 3671 - RNA, 25 nt, Artificial Sequence
  Description of Artificial Sequence: Synthetic oligonucleotide
ccgagggccacccugagagcagcug

SEQ ID NO: 3672 - RNA, 25 nt, Artificial Sequence
  Description of Artificial Sequence: Synthetic oligonucleotide
gccacccugagagcagcugccuccc

SEQ ID NO: 3673 - RNA, 25 nt, Artificial Sequence
  Description of Artificial Sequence: Synthetic oligonucleotide
cugccgcagcagccaccagcuccuc

SEQ ID NO: 3674 - RNA, 25 nt, Artificial Sequence
  Description of Artificial Sequence: Synthetic oligonucleotide
cuuucccaggcuuaagcagcugcuc

SEQ ID NO: 3675 - RNA, 25 nt, Artificial Sequence
  Description of Artificial Sequence: Synthetic oligonucleotide
gcaacuucuucagcagcagcaacaa

SEQ ID NO: 3676 - RNA, 25 nt, Artificial Sequence
  Description of Artificial Sequence: Synthetic oligonucleotide
gcgucccacuccuugugcgccgcug

SEQ ID NO: 3677 - RNA, 25 nt, Artificial Sequence
  Description of Artificial Sequence: Synthetic oligonucleotide
ggcagcagugaagcagguagcucug

SEQ ID NO: 3678 - RNA, 25 nt, Artificial Sequence
  Description of Artificial Sequence: Synthetic oligonucleotide
uccgcuggcucuguccgggccgccg

SEQ ID NO: 3679 - RNA, 25 nt, Artificial Sequence
  Description of Artificial Sequence: Synthetic oligonucleotide
agcgccugggcugcggcggcagcgc

SEQ ID NO: 3680 - RNA, 25 nt, Artificial Sequence
  Description of Artificial Sequence: Synthetic oligonucleotide
cugggcugcggcggcagcgcaaugc

SEQ ID NO: 3681 - RNA, 25 nt, Artificial Sequence
  Description of Artificial Sequence: Synthetic oligonucleotide
gcggcggcagcgcaaugccgcuaug

SEQ ID NO: 3682 - RNA, 25 nt, Artificial Sequence
  Description of Artificial Sequence: Synthetic oligonucleotide
uagccgggcccagcacuggaucgcc

SEQ ID NO: 3683 - RNA, 25 nt, Artificial Sequence
  Description of Artificial Sequence: Synthetic oligonucleotide
uccuggcauacucucuucacagcug

SEQ ID NO: 3684 - RNA, 25 nt, Artificial Sequence
  Description of Artificial Sequence: Synthetic oligonucleotide
cagcccaagcgaugccgggccugua

SEQ ID NO: 3685 - RNA, 25 nt, Artificial Sequence
  Description of Artificial Sequence: Synthetic oligonucleotide
uucuggcugucacuacggagcucuc

SEQ ID NO: 3686 - RNA, 25 nt, Artificial Sequence
  Description of Artificial Sequence: Synthetic oligonucleotide
gagcucucacuuguggcagcugcaa

SEQ ID NO: 3687 - RNA, 25 nt, Artificial Sequence
  Description of Artificial Sequence: Synthetic oligonucleotide
cuuguggcagcugcaaggucuucuu

SEQ ID NO: 3688 - RNA, 25 nt, Artificial Sequence
  Description of Artificial Sequence: Synthetic oligonucleotide
ggcagcugcaaggucuucuucaaaa

SEQ ID NO: 3689 - RNA, 25 nt, Artificial Sequence
  Description of Artificial Sequence: Synthetic oligonucleotide
gaugacucugggagcucguaagcug

SEQ ID NO: 3690 - RNA, 25 nt, Artificial Sequence
  Description of Artificial Sequence: Synthetic oligonucleotide
gggagcucguaagcugaagaaacuu

SEQ ID NO: 3691 - RNA, 25 nt, Artificial Sequence
  Description of Artificial Sequence: Synthetic oligonucleotide
gauuccuuugcugccuuguuaucua

SEQ ID NO: 3692 - RNA, 25 nt, Artificial Sequence
  Description of Artificial Sequence: Synthetic oligonucleotide
uugcugccuuguuaucuagccucaa

SEQ ID NO: 3693 - RNA, 25 nt, Artificial Sequence
  Description of Artificial Sequence: Synthetic oligonucleotide
gccuggcuuccgcaacuugcaugug

SEQ ID NO: 3694 - RNA, 25 nt, Artificial Sequence
  Description of Artificial Sequence: Synthetic oligonucleotide
gaugggacugaugguauuugccaug

SEQ ID NO: 3695 - RNA, 25 nt, Artificial Sequence
  Description of Artificial Sequence: Synthetic oligonucleotide
ggaugcucuacuuugcaccugacuu

SEQ ID NO: 3696 - RNA, 25 nt, Artificial Sequence
  Description of Artificial Sequence: Synthetic oligonucleotide
cucuacuuugcaccugacuugguuu

SEQ ID NO: 3697 - RNA, 25 nt, Artificial Sequence
  Description of Artificial Sequence: Synthetic oligonucleotide
uugcaccugacuugguuuucaauga

SEQ ID NO: 3698 - RNA, 25 nt, Artificial Sequence
  Description of Artificial Sequence: Synthetic oligonucleotide
cuugguuuucaaugaguaccgcaug

SEQ ID NO: 3699 - RNA, 25 nt, Artificial Sequence
  Description of Artificial Sequence: Synthetic oligonucleotide
guaccgcaugcacaagucucggaug

SEQ ID NO: 3700 - RNA, 25 nt, Artificial Sequence
  Description of Artificial Sequence: Synthetic oligonucleotide
gugcaugaaagcacugcugcucuuc

SEQ ID NO: 3701 - RNA, 25 nt, Artificial Sequence
  Description of Artificial Sequence: Synthetic oligonucleotide
ugaaagcacugcugcucuucagcau

SEQ ID NO: 3702 - RNA, 25 nt, Artificial Sequence
  Description of Artificial Sequence: Synthetic oligonucleotide
cacugcugcucuucagcauuauucc

SEQ ID NO: 3703 - RNA, 25 nt, Artificial Sequence
  Description of Artificial Sequence: Synthetic oligonucleotide
cugcucuucagcauuauuccagugg

SEQ ID NO: 3704 - RNA, 25 nt, Artificial Sequence
  Description of Artificial Sequence: Synthetic oligonucleotide
cucaccaagcuccuggauucugugc

SEQ ID NO: 3705 - RNA, 25 nt, Artificial Sequence
  Description of Artificial Sequence: Synthetic oligonucleotide
cuccuggauucugugcagccuauug

SEQ ID NO: 3706 - RNA, 25 nt, Artificial Sequence
  Description of Artificial Sequence: Synthetic oligonucleotide
ggauucugugcagccuauugcaaga

SEQ ID NO: 3707 - RNA, 25 nt, Artificial Sequence
  Description of Artificial Sequence: Synthetic oligonucleotide
ugugcagccuauugcaagagagcug

SEQ ID NO: 3708 - RNA, 25 nt, Artificial Sequence
  Description of Artificial Sequence: Synthetic oligonucleotide
gccuauugcaagagagcugcaucag

SEQ ID NO: 3709 - RNA, 25 nt, Artificial Sequence
  Description of Artificial Sequence: Synthetic oligonucleotide
guggacuuuccugaaaugauggcag

SEQ ID NO: 3710 - RNA, 25 nt, Artificial Sequence
  Description of Artificial Sequence: Synthetic oligonucleotide
uucugccuguuauauaacucugcac

SEQ ID NO: 3711 - RNA, 25 nt, Artificial Sequence
  Description of Artificial Sequence: Synthetic oligonucleotide
cacuacuucucugcagugccuuggg

SEQ ID NO: 3712 - RNA, 25 nt, Artificial Sequence
  Description of Artificial Sequence: Synthetic oligonucleotide
cugggcuucuccuucuuuuuuuuuc

SEQ ID NO: 3713 - RNA, 25 nt, Artificial Sequence
  Description of Artificial Sequence: Synthetic oligonucleotide
uucuccuucuuuuuuuuucuucuuc

SEQ ID NO: 3714 - RNA, 25 nt, Artificial Sequence
  Description of Artificial Sequence: Synthetic oligonucleotide
cuuuuuuuuucuucuucccucccuc

SEQ ID NO: 3715 - RNA, 25 nt, Artificial Sequence
  Description of Artificial Sequence: Synthetic oligonucleotide
gcugcguauuguggcuccugccuuu

SEQ ID NO: 3716 - RNA, 25 nt, Artificial Sequence
  Description of Artificial Sequence: Synthetic oligonucleotide
uggcuccugccuuuguuuugauuuc

SEQ ID NO: 3717 - RNA, 25 nt, Artificial Sequence
  Description of Artificial Sequence: Synthetic oligonucleotide
ccugccuuuguuuugauuucuguug

SEQ ID NO: 3718 - DNA, 21 bp, Artificial Sequence
  Description of Artificial Sequence: Synthetic oligonucleotide
ggcagcagcacactgaggatg

SEQ ID NO: 3719 - DNA, 21 bp, Artificial Sequence
  Description of Artificial Sequence: Synthetic oligonucleotide
ctccgagggccaccctgagag

SEQ ID NO: 3720 - DNA, 21 bp, Artificial Sequence
  Description of Artificial Sequence: Synthetic oligonucleotide
gggccaccctgagagcagctg

SEQ ID NO: 3721 - DNA, 21 bp, Artificial Sequence
  Description of Artificial Sequence: Synthetic oligonucleotide
ggctgccgcagcagccaccag

SEQ ID NO: 3722 - DNA, 21 bp, Artificial Sequence
  Description of Artificial Sequence: Synthetic oligonucleotide
cactttcccaggcttaagcag

SEQ ID NO: 3723 - DNA, 21 bp, Artificial Sequence
  Description of Artificial Sequence: Synthetic oligonucleotide
atgcaacttcttcagcagcag

SEQ ID NO: 3724 - DNA, 21 bp, Artificial Sequence
  Description of Artificial Sequence: Synthetic oligonucleotide
gtgcgtcccactccttgtgcg

SEQ ID NO: 3725 - DNA, 21 bp, Artificial Sequence
  Description of Artificial Sequence: Synthetic oligonucleotide
ctggcagcagtgaagcaggta

SEQ ID NO: 3726 - DNA, 21 bp, Artificial Sequence
  Description of Artificial Sequence: Synthetic oligonucleotide
tttccgctggctctgtccggg

SEQ ID NO: 3727 - DNA, 21 bp, Artificial Sequence
  Description of Artificial Sequence: Synthetic oligonucleotide
gcagcgcctgggctgcggcgg

SEQ ID NO: 3728 - DNA, 21 bp, Artificial Sequence
  Description of Artificial Sequence: Synthetic oligonucleotide
gcctgggctgcggcggcagcg

SEQ ID NO: 3729 - DNA, 21 bp, Artificial Sequence
  Description of Artificial Sequence: Synthetic oligonucleotide
ctgcggcggcagcgcaatgcc

SEQ ID NO: 3730 - DNA, 21 bp, Artificial Sequence
  Description of Artificial Sequence: Synthetic oligonucleotide
tgtagccgggcccagcactgg

SEQ ID NO: 3731 - DNA, 21 bp, Artificial Sequence
  Description of Artificial Sequence: Synthetic oligonucleotide
cttcctggcatactctcttca

SEQ ID NO: 3732 - DNA, 21 bp, Artificial Sequence
  Description of Artificial Sequence: Synthetic oligonucleotide
agcagcccaagcgatgccggg

SEQ ID NO: 3733 - DNA, 21 bp, Artificial Sequence
  Description of Artificial Sequence: Synthetic oligonucleotide
gcttctggctgtcactacgga

SEQ ID NO: 3734 - DNA, 21 bp, Artificial Sequence
  Description of Artificial Sequence: Synthetic oligonucleotide
cggagctctcacttgtggcag

SEQ ID NO: 3735 - DNA, 21 bp, Artificial Sequence
  Description of Artificial Sequence: Synthetic oligonucleotide
cacttgtggcagctgcaaggt

SEQ ID NO: 3736 - DNA, 21 bp, Artificial Sequence
  Description of Artificial Sequence: Synthetic oligonucleotide
gtggcagctgcaaggtcttct

SEQ ID NO: 3737 - DNA, 21 bp, Artificial Sequence
  Description of Artificial Sequence: Synthetic oligonucleotide
gggatgactctgggagctcgt

SEQ ID NO: 3738 - DNA, 21 bp, Artificial Sequence
  Description of Artificial Sequence: Synthetic oligonucleotide
ctgggagctcgtaagctgaag

SEQ ID NO: 3739 - DNA, 21 bp, Artificial Sequence
  Description of Artificial Sequence: Synthetic oligonucleotide
cagattcctttgctgccttgt

SEQ ID NO: 3740 - DNA, 21 bp, Artificial Sequence
  Description of Artificial Sequence: Synthetic oligonucleotide
ctttgctgccttgttatctag

SEQ ID NO: 3741 - DNA, 21 bp, Artificial Sequence
  Description of Artificial Sequence: Synthetic oligonucleotide
ttgcctggcttccgcaacttg

SEQ ID NO: 3742 - DNA, 21 bp, Artificial Sequence
  Description of Artificial Sequence: Synthetic oligonucleotide
tggatgggactgatggtattt

SEQ ID NO: 3743 - DNA, 21 bp, Artificial Sequence
  Description of Artificial Sequence: Synthetic oligonucleotide
caggatgctctactttgcacc

SEQ ID NO: 3744 - DNA, 21 bp, Artificial Sequence
  Description of Artificial Sequence: Synthetic oligonucleotide
tgctctactttgcacctgact

SEQ ID NO: 3745 - DNA, 21 bp, Artificial Sequence
  Description of Artificial Sequence: Synthetic oligonucleotide
ctttgcacctgacttggtttt

SEQ ID NO: 3746 - DNA, 21 bp, Artificial Sequence
  Description of Artificial Sequence: Synthetic oligonucleotide
gacttggttttcaatgagtac

SEQ ID NO: 3747 - DNA, 21 bp, Artificial Sequence
  Description of Artificial Sequence: Synthetic oligonucleotide
gagtaccgcatgcacaagtct

SEQ ID NO: 3748 - DNA, 21 bp, Artificial Sequence
  Description of Artificial Sequence: Synthetic oligonucleotide
ctgtgcatgaaagcactgctg

SEQ ID NO: 3749 - DNA, 21 bp, Artificial Sequence
  Description of Artificial Sequence: Synthetic oligonucleotide
catgaaagcactgctgctctt

SEQ ID NO: 3750 - DNA, 21 bp, Artificial Sequence
  Description of Artificial Sequence: Synthetic oligonucleotide
agcactgctgctcttcagcat

SEQ ID NO: 3751 - DNA, 21 bp, Artificial Sequence
  Description of Artificial Sequence: Synthetic oligonucleotide
tgctgctcttcagcattattc

SEQ ID NO: 3752 - DNA, 21 bp, Artificial Sequence
  Description of Artificial Sequence: Synthetic oligonucleotide
agctcaccaagctcctggatt

SEQ ID NO: 3753 - DNA, 21 bp, Artificial Sequence
  Description of Artificial Sequence: Synthetic oligonucleotide
agctcctggattctgtgcagc

SEQ ID NO: 3754 - DNA, 21 bp, Artificial Sequence
  Description of Artificial Sequence: Synthetic oligonucleotide
ctggattctgtgcagcctatt

SEQ ID NO: 3755 - DNA, 21 bp, Artificial Sequence
  Description of Artificial Sequence: Synthetic oligonucleotide
tctgtgcagcctattgcaaga

SEQ ID NO: 3756 - DNA, 21 bp, Artificial Sequence
  Description of Artificial Sequence: Synthetic oligonucleotide
cagcctattgcaagagagctg

SEQ ID NO: 3757 - DNA, 21 bp, Artificial Sequence
  Description of Artificial Sequence: Synthetic oligonucleotide
gcgtggactttcctgaaatga

SEQ ID NO: 3758 - DNA, 21 bp, Artificial Sequence
  Description of Artificial Sequence: Synthetic oligonucleotide
tcttctgcctgttatataact

SEQ ID NO: 3759 - DNA, 21 bp, Artificial Sequence
  Description of Artificial Sequence: Synthetic oligonucleotide
tgcactacttctctgcagtgc

SEQ ID NO: 3760 - DNA, 21 bp, Artificial Sequence
  Description of Artificial Sequence: Synthetic oligonucleotide
tcctgggcttctccttctttt

SEQ ID NO: 3761 - DNA, 21 bp, Artificial Sequence
  Description of Artificial Sequence: Synthetic oligonucleotide
gcttctccttctttttttttc

SEQ ID NO: 3762 - DNA, 21 bp, Artificial Sequence
  Description of Artificial Sequence: Synthetic oligonucleotide
ttctttttttttcttcttccc

SEQ ID NO: 3763 - DNA, 21 bp, Artificial Sequence
  Description of Artificial Sequence: Synthetic oligonucleotide
ctgctgcgtattgtggctcct

SEQ ID NO: 3764 - DNA, 21 bp, Artificial Sequence
  Description of Artificial Sequence: Synthetic oligonucleotide
tgtggctcctgcctttgtttt

SEQ ID NO: 3765 - DNA, 21 bp, Artificial Sequence
  Description of Artificial Sequence: Synthetic oligonucleotide
ctcctgcctttgttttgattt

SEQ ID NO: 3766 - DNA, 4314 bp, Homo sapiens
cgagatcccggggagccagcttgctgggagagcgggacggtccggagcaagcccagaggcagaggaggcgacagagggaaaaagggccgagctagccgctccagtgctgtacaggagccgaagggacgcaccacgccagccccagcccggctccagcgacagccaacgcctcttgcagcgcggcggcttcgaagccgccgcccggagctgccctttcctcttcggtgaagtttttaaaagctgctaaagactcggaggaagcaaggaaagtgcctggtaggactgacggctgcctttgtcctcctcctctccaccccgcctccccccaccctgccttccccccctcccccgtcttctctcccgcagctgcctcagtcggctactctcagccaacccccctcaccacccttctccccacccgcccccccgcccccgtcggcccagcgctgccagcccgagtttgcagagaggtaactccctttggctgcgagcgggcgagctagctgcacattgcaaagaaggctcttaggagccaggcgactggggagcggcttcagcactgcagccacgacccgcctggttaggctgcacgcggagagaaccctctgttttcccccactctctctccacctcctcctgccttccccaccccgagtgcggagccagagatcaaaagatgaaaaggcagtcaggtcttcagtagccaaaaaacaaaacaaacaaaaacaaaaaagccgaaataaaagaaaaagataataactcagttcttatttgcacctacttcagtggacactgaatttggaaggtggaggattttgtttttttcttttaagatctgggcatcttttgaatctacccttcaagtattaagagacagactgtgagcctagcagggcagatcttgtccaccgtgtgtcttcttctgcacgagactttgaggctgtcagagcgctttttgcgtggttgctcccgcaagtttccttctctggagcttcccgcaggtgggcagctagctgcagcgactaccgcatcatcacagcctgttgaactcttctgagcaagagaaggggaggcggggtaagggaagtaggtggaagattcagccaagctcaaggatggaagtgcagttagggctgggaagggtctaccctcggccgccgtccaagacctaccgaggagctttccagaatctgttccagagcgtgcgcgaagtgatccagaacccgggccccaggcacccagaggccgcgagcgcagcacctcccggcgccagtttgctgctgctgcagcagcagcagcagcagcagcagcagcagcagcagcagcagcagcagcagcagcagcagcagcagcaagagactagccccaggcagcagcagcagcagcagggtgaggatggttctccccaagcccatcgtagaggccccacaggctacctggtcctggatgaggaacagcaaccttcacagccgcagtcggccctggagtgccaccccgagagaggttgcgtcccagagcctggagccgccgtggccgccagcaaggggctgccgcagcagctgccagcacctccggacgaggatgactcagctgccccatccacgttgtccctgctgggccccactttccccggcttaagcagctgctccgctgaccttaaagacatcctgagcgaggccagcaccatgcaactccttcagcaacagcagcaggaagcagtatccgaaggcagcagcagcgggagagcgagggaggcctcgggggctcccacttcctccaaggacaattacttagggggcacttcgaccatttctgacaacgccaaggagttgtgtaaggcagtgtcggtgtccatgggcctgggtgtggaggcgttggagcatctgagtccaggggaacagcttcggggggattgcatgtacgccccacttttgggagttccacccgctgtgcgtcccactccttgtgccccattggccgaatgcaaaggttctctgctagacgacagcgcaggcaagagcactgaagatactgctgagtattcccctttcaagggaggttacaccaaagggctagaaggcgagagcctaggctgctctggcagcgctgcagcagggagctccgggacacttgaactgccgtctaccctgtctctctacaagtccggagcactggacgaggcagctgcgtaccagagtcgcgactactacaactttccactggctctggccggaccgccgccccctccgccgcctccccatccccacgctcgcatcaagctggagaacccgctggactacggcagcgcctgggcggctgcggcggcgcagtgccgctatggggacctggcgagcctgcatggcgcgggtgcagcgggacccggttctgggtcaccctcagccgccgcttcctcatcctggcacactctcttcacagccgaagaaggccagttgtatggaccgtgtggtggtggtgggggtggtggcggcggcggcggcggcggcggcggcggcggcggcggcggcggcggcggcgaggcgggagctgtagccccctacggctacactcggccccctcaggggctggcgggccaggaaagcgacttcaccgcacctgatgtgtggtaccctggcggcatggtgagcagagtgccctatcccagtcccacttgtgtcaaaagcgaaatgggcccctggatggatagctactccggaccttacggggacatgcgtttggagactgccagggaccatgttttgcccattgactattactttccaccccagaagacctgcctgatctgtggagatgaagcttctgggtgtcactatggagctctcacatgtggaagctgcaaggtcttcttcaaaagagccgctgaagggaaacagaagtacctgtgcgccagcagaaatgattgcactattgataaattccgaaggaaaaattgtccatcttgtcgtcttcggaaatgttatgaagcagggatgactctgggagcccggaagctgaagaaacttggtaatctgaaactacaggaggaaggagaggcttccagcaccaccagccccactgaggagacaacccagaagctgacagtgtcacacattgaaggctatgaatgtcagcccatctttctgaatgtcctggaagccattgagccaggtgtagtgtgtgctggacacgacaacaaccagcccgactcctttgcagccttgctctctagcctcaatgaactgggagagagacagcttgtacacgtggtcaagtgggccaaggccttgcctggcttccgcaacttacacgtggacgaccagatggctgtcattcagtactcctggatggggctcatggtgtttgccatgggctggcgatccttcaccaatgtcaactccaggatgctctacttcgcccctgatctggttttcaatgagtaccgcatgcacaagtcccggatgtacagccagtgtgtccgaatgaggcacctctctcaagagtttggatggctccaaatcaccccccaggaattcctgtgcatgaaagcactgctactcttcagcattattccagtggatgggctgaaaaatcaaaaattctttgatgaacttcgaatgaactacatcaaggaactcgatcgtatcattgcatgcaaaagaaaaaatcccacatcctgctcaagacgcttctaccagctcaccaagctcctggactccgtgcagcctattgcgagagagctgcatcagttcacttttgacctgctaatcaagtcacacatggtgagcgtggactttccggaaatgatggcagagatcatctctgtgcaagtgcccaagatcctttctgggaaagtcaagcccatctatttccacacccagtgaagcattggaaaccctatttccccaccccagctcatgccccctttcagatgtcttctgcctgttataactctgcactactcctctgcagtgccttggggaatttcctctattgatgtacagtctgtcatgaacatgttcctgaattctatttgctgggctttttttttctctttctctcctttctttttcttcttccctccctatctaaccctcccatggcaccttcagactttgcttcccattgtggctcctatctgtgttttgaatggtgttgtatgcctttaaatctgtgatgatcctcatatggcccagtgtcaagttgtgcttgtttacagcactactctgtgccagccacacaaacgtttacttatcttatgccacgggaagtttagagagctaagattatctggggaaatcaaaacaaaaacaagcaaac

SEQ ID NO: 3767 - protein, 920 aa, Homo sapiens
MEVQLGLGRVYPRPPSKTYRGAFQNLFQSVREVIQNPGPRHPEAASAAPPGASLLLLQQQQQQQQQQQQQQQQQQQQQQQETSPRQQQQQQGEDGSPQAHRRGPTGYLVLDEEQQPSQPQSALECHPERGCVPEPGAAVAASKGLPQQLPAPPDEDDSAAPSTLSLLGPTFPGLSSCSADLKDILSEASTMQLLQQQQQEAVSEGSSSGRAREASGAPTSSKDNYLGGTSTISDNAKELCKAVSVSMGLGVEALEHLSPGEQLRGDCMYAPLLGVPPAVRPTPCAPLAECKGSLLDDSAGKSTEDTAEYSPFKGGYTKGLEGESLGCSGSAAAGSSGTLELPSTLSLYKSGALDEAAAYQSRDYYNFPLALAGPPPPPPPPHPHARIKLENPLDYGSAWAAAAAQCRYGDLASLHGAGAAGPGSGSPSAAASSSWHTLFTAEEGQLYGPCGGGGGGGGGGGGGGGGGGGGGGGEAGAVAPYGYTRPPQGLAGQESDFTAPDVWYPGGMVSRVPYPSPTCVKSEMGPWMDSYSGPYGDMRLETARDHVLPIDYYFPPQKTCLICGDEASGCHYGALTCGSCKVFFKRAAEGKQKYLCASRNDCTIDKFRRKNCPSCRLRKCYEAGMTLGARKLKKLGNLKLQEEGEASSTTSPTEETTQKLTVSHIEGYECQPIFLNVLEAIEPGVVCAGHDNNQPDSFAALLSSLNELGERQLVHVVKWAKALPGFRNLHVDDQMAVIQYSWMGLMVFAMGWRSFTNVNSRMLYFAPDLVFNEYRMHKSRMYSQCVRMRHLSQEFGWLQITPQEFLCMKALLLFSIIPVDGLKNQKFFDELRMNYIKELDRIIACKRKNPTSCSRRFYQLTKLLDSVQPIARELHQFTFDLLIKSHMVSVDFPEMMAEIISVQVPKILSGKVKPIYFHTQ

SEQ ID NO: 3768 - DNA, 1765 bp, Homo sapiens
gctgcgagcagagagggattcctcggaggtcatctgttccatcttcttgcctatgcaaatgcctgcctgaagctgctggaggctggctttgtaccggactttgtacagggaaccagggaaacgaatgcagagtgctcctgacattgcctgtcactttttcccatgatactctggcttcacagtttggagactgccagggaccatgttttgcccattgactattactttccaccccagaagacctgcctgatctgtggagatgaagcttctgggtgtcactatggagctctcacatgtggaagctgcaaggtcttcttcaaaagagccgctgaagggaaacagaagtacctgtgcgccagcagaaatgattgcactattgataaattccgaaggaaaaattgtccatcttgtcgtcttcggaaatgttatgaagcagggatgactctgggagcccggaagctgaagaaacttggtaatctgaaactacaggaggaaggagaggcttccagcaccaccagccccactgaggagacaacccagaagctgacagtgtcacacattgaaggctatgaatgtcagcccatctttctgaatgtcctggaagccattgagccaggtgtagtgtgtgctggacacgacaacaaccagcccgactcctttgcagccttgctctctagcctcaatgaactgggagagagacagcttgtacacgtggtcaagtgggccaaggccttgcctggcttccgcaacttacacgtggacgaccagatggctgtcattcagtactcctggatggggctcatggtgtttgccatgggctggcgatccttcaccaatgtcaactccaggatgctctacttcgcccctgatctggttttcaatgagtaccgcatgcacaagtcccggatgtacagccagtgtgtccgaatgaggcacctctctcaagagtttggatggctccaaatcaccccccaggaattcctgtgcatgaaagcactgctactcttcagcattattccagtggatgggctgaaaaatcaaaaattctttgatgaacttcgaatgaactacatcaaggaactcgatcgtatcattgcatgcaaaagaaaaaatcccacatcctgctcaagacgcttctaccagctcaccaagctcctggactccgtgcagcctattgcgagagagctgcatcagttcacttttgacctgctaatcaagtcacacatggtgagcgtggactttccggaaatgatggcagagatcatctctgtgcaagtgcccaagatcctttctgggaaagtcaagcccatctatttccacacccagtgaagcattggaaaccctatttccccaccccagctcatgccccctttcagatgtcttctgcctgttataactctgcactactcctctgcagtgccttggggaatttcctctattgatgtacagtctgtcatgaacatgttcctgaattctatttgctgggctttttttttctctttctctcctttctttttcttcttccctccctatctaaccctcccatggcaccttcagactttgcttcccattgtggctcctatctgtgttttgaatggtgttgtatgcctttaaatctgtgatgatcctcatatggcccagtgtcaagttgtgcttgtttacagcactactctgtgccagccacacaaacgtttacttatcttatgccacgggaagtttagagagctaagattatctggggaaatcaaaacaaaaacaagcaaac

SEQ ID NO: 3769 - protein, 388 aa, Homo sapiens
MILWLHSLETARDHVLPIDYYFPPQKTCLICGDEASGCHYGALTCGSCKVFFKRAAEGKQKYLCASRNDCTIDKFRRKNCPSCRLRKCYEAGMTLGARKLKKLGNLKLQEEGEASSTTSPTEETTQKLTVSHIEGYECQPIFLNVLEAIEPGVVCAGHDNNQPDSFAALLSSLNELGERQLVHVVKWAKALPGFRNLHVDDQMAVIQYSWMGLMVFAMGWRSFTNVNSRMLYFAPDLVFNEYRMHKSRMYSQCVRMRHLSQEFGWLQITPQEFLCMKALLLFSIIPVDGLKNQKFFDELRMNYIKELDRIIACKRKNPTSCSRRFYQLTKLLDSVQPIARELHQFTFDLLIKSHMVSVDFPEMMAEIISVQVPKILSGKVKPIYFHTQ

SEQ ID NO: 3770 - DNA, 2999 bp, Mus musculus
gaattcggtggaagctacagacaagctcaaggatggaggtgcagttagggctgggaagggtctacccacggcccccatccaagacctatcgaggagcgttccagaatctgttccagagcgtgcgcgaagcgatccagaacccgggccccaggcaccctgaggccgctaacatagcacctcccggcgcctgtttacagcagaggcaggagactagcccccggcggcggcggcggcagcagcacactgaggatggttctcctcaagcccacatcagaggccccacaggctacctggccctggaggaggaacagcagccttcacagcagcaggcagcctccgagggccaccctgagagcagctgcctccccgagcctggggcggccaccgctcctggcaaggggctgccgcagcagccaccagctcctccagatcaggatgactcagctgccccatccacgttgtccctgctgggccccactttcccaggcttaagcagctgctccgccgacattaaagacattttgaacgaggccggcaccatgcaacttcttcagcagcagcaacaacagcagcagcaccaacagcagcaccaacagcaccaacagcagcaggaggtaatctccgaaggcagcagcgcaagagccagggaggccacgggggctccctcttcctccaaggatagttacctagggggcaattcaaccatatctgacagtgccaaggagttgtgtaaagcagtgtctgtgtccatgggattgggtgtggaagcattggaacatctgagtccaggggaacagcttcggggagactgcatgtacgcgtcgctcctgggaggtccacccgcggtgcgtcccactccttgtgcgccgctgcccgaatgcaaaggtcttcccctggacgaaggcccaggcaaaagcactgaagagactgctgagtattcctctttcaagggaggttacgccaaaggattggaaggtgagagcttggggtgctctggcagcagtgaagcaggtagctctgggacacttgagatcccgtcctctctgtctctgtataaatctggagcactagacgaggcagcagcataccagaatcgcgactactacaactttccgctggctctgtccgggccgccgcaccccccgccccctacccatccacacgcccgtatcaagctggagaacccattggactacggcagcgcctgggctgcggcggcagcgcaatgccgctatggggacttgggtagtctacatggagggagtgtagccgggcccagcactggatcgcccccagccaccacctcttcttcctggcatactctcttcacagctgaagaaggccaattatatgggccaggaggcgggggcggcagcagcagcccaagcgatgccgggcctgtagccccctatggctacactcggccccctcaggggctgacaagccaggagagtgactactctgcctccgaagtgtggtatcctggtggagttgtgaacagagtaccctatcccagtcccaattgtgtcaaaagtgaaatgggaccttggatggagaactactccggaccttatggggacatgcgtttggacagtaccagggaccatgttttacccatcgactattactttccaccccagaagacctgcctgatctgtggagatgaagcttctggctgtcactacggagctctcacttgtggcagctgcaaggtcttcttcaaaagagccgctgaagggaaacagaagtatctatgtgccagcagaaacgattgtaccattgataaatttcggaggaaaaattgcccatcttgtcgtctccggaaatgttatgaagcagggatgactctgggagctcgtaagctgaagaaacttggaaatctaaaactacaggaggaaggagaaaactccaatgctggcagccccactgaggacccatcccagaagatgactgtatcacacattgaaggctatgaatgtcagcctatctttcttaacgtcctggaagccattgagccaggagtggtgtgtgccggacatgacaacaaccaaccagattcctttgctgccttgttatctagcctcaatgagcttggagagaggcagcttgtgcatgtggtcaagtgggccaaggccttgcctggcttccgcaacttgcatgtggatgaccagatggcggtcattcagtattcctggatgggactgatggtatttgccatgggttggcggtccttcactaatgtcaactccaggatgctctactttgcacctgacttggttttcaatgagtaccgcatgcacaagtctcggatgtacagccagtgtgtgaggatgaggcacctgtctcaagagtttggatggctccaaataaccccccaggaattcctgtgcatgaaagcactgctgctcttcagcattattccagtggatgggctgaaaaatcaaaaattctttgatgaacttcgaatgaactacatcaaggaactcgatcgcatcattgcatgcaaaagaaagaatcccacatcctgctcaaggcgcttctaccagctcaccaagctcctggattctgtgcagcctattgcaagagagctgcatcagttcacttttgacctgctaatcaagtcccatatggtgagcgtggactttcctgaaatgatggcagagatcatctctgtgcaagtgcccaagatcctttctgggaaagtcaagcccatctatttccacacacagtgaagatttggaaaccctaatacccaaaacccaccttgttccctttccagatgtcttctgcctgttatataactctgcactacttctctgcagtgccttgggggaaattcctctactgatgtacagtctgtcgtgaacaggttcctcagttctatttcctgggcttctccttctttttttttcttcttccctccctctttcaccctcccatggcacattttgaatctgctgcgtattgtggctcctgcctttgttttgatttctgttgta

SEQ ID NO: 3771 - protein, 899 aa, Mus musculus
MEVQLGLGRVYPRPPSKTYRGAFQNLFQSVREAIQNPGPRHPEAANIAPPGACLQQRQETSPRRRRRQQHTEDGSPQAHIRGPTGYLALEEEQQPSQQQAASEGHPESSCLPEPGAATAPGKGLPQQPPAPPDQDDSAAPSTLSLLGPTFPGLSSCSADIKDILNEAGTMQLLQQQQQQQQHQQQHQQHQQQQEVISEGSSARAREATGAPSSSKDSYLGGNSTISDSAKELCKAVSVSMGLGVEALEHLSPGEQLRGDCMYASLLGGPPAVRPTPCAPLPECKGLPLDEGPGKSTEETAEYSSFKGGYAKGLEGESLGCSGSSEAGSSGTLEIPSSLSLYKSGALDEAAAYQNRDYYNFPLALSGPPHPPPPTHPHARIKLENPLDYGSAWAAAAAQCRYGDLGSLHGGSVAGPSTGSPPATTSSSWHTLFTAEEGQLYGPGGGGGSSSPSDAGPVAPYGYTRPPQGLTSQESDYSASEVWYPGGVVNRVPYPSPNCVKSEMGPWMENYSGPYGDMRLDSTRDHVLPIDYYFPPQKTCLICGDEASGCHYGALTCGSCKVFFKRAAEGKQKYLCASRNDCTIDKFRRKNCPSCRLRKCYEAGMTLGARKLKKLGNLKLQEEGENSNAGSPTEDPSQKMTVSHIEGYECQPIFLNVLEAIEPGVVCAGHDNNQPDSFAALLSSLNELGERQLVHVVKWAKALPGFRNLHVDDQMAVIQYSWMGLMVFAMGWRSFTNVNSRMLYFAPDLVFNEYRMHKSRMYSQCVRMRHLSQEFGWLQITPQEFLCMKALLLFSIIPVDGLKNQKFFDELRMNYIKELDRIIACKRKNPTSCSRRFYQLTKLLDSVQPIARELHQFTFDLLIKSHMVSVDFPEMMAEIISVQVPKILSGKVKPIYFHTQ

SEQ ID NO: 3772 - DNA, 25 bp, Artificial Sequence
  Description of Artificial Sequence: Synthetic oligonucleotide
  Description of Combined DNA/RNA Molecule: Synthetic oligonucleotide
gaaaaagauaauaacucaguuauta

SEQ ID NO: 3773 - DNA, 25 bp, Artificial Sequence
  Description of Artificial Sequence: Synthetic oligonucleotide
  Description of Combined DNA/RNA Molecule: Synthetic oligonucleotide
gaaaaagauaauaacucaguucgta

SEQ ID NO: 3774 - DNA, 25 bp, Artificial Sequence
  Description of Artificial Sequence: Synthetic oligonucleotide
  Description of Combined DNA/RNA Molecule: Synthetic oligonucleotide
gaaaaagauaauaacucaguucuga

SEQ ID NO: 3775 - DNA, 25 bp, Artificial Sequence
  Description of Artificial Sequence: Synthetic oligonucleotide
  Description of Combined DNA/RNA Molecule: Synthetic oligonucleotide
gaaaaagauaauaacucaguucutc

SEQ ID NO: 3776 - RNA, 27 nt, Artificial Sequence
  Description of Artificial Sequence: Synthetic oligonucleotide
gaagaacugaguuauuaucuuuuucuu

SEQ ID NO: 3777 - RNA, 27 nt, Artificial Sequence
  Description of Artificial Sequence: Synthetic oligonucleotide
ucagaacugaguuauuaucuuuuucuu

SEQ ID NO: 3778 - RNA, 27 nt, Artificial Sequence
  Description of Artificial Sequence: Synthetic oligonucleotide
uacgaacugaguuauuaucuuuuucuu

SEQ ID NO: 3779 - RNA, 27 nt, Artificial Sequence
  Description of Artificial Sequence: Synthetic oligonucleotide
uaauaacugaguuauuaucuuuuucuu

SEQ ID NO: 3780 - DNA, 104 bp, Artificial Sequence
  Description of Artificial Sequence: Synthetic oligonucleotide
  Description of Combined DNA/RNA Molecule: Synthetic oligonucleotide
  modified_base (22)..(24): a, c, t, g, u, unknown or other
  modified_base (25)..(104): a, c, t, g, u, unknown or other and this region may encompass 1 to 5, 1 to 10, 1 to 20, 1 to 30, 1 to 50, or 1 to 80 nucleotides
  see specification as filed for detailed description of substitutions and preferred embodiments
gaaaaagauaauaacucaguunnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 3781 - DNA, 106 bp, Artificial Sequence
  Description of Artificial Sequence: Synthetic oligonucleotide
  Description of Combined DNA/RNA Molecule: Synthetic oligonucleotide
  modified_base (1)..(80): a, c, t, g, u, unknown or other and this region may encompass 1 to 5, 1 to 10, 1 to 20, 1 to 30, 1 to 50, or 1 to 80 nucleotides
  modified_base (81)..(85): a, c, t, g, u, unknown or other
  see specification as filed for detailed description of substitutions and preferred embodiments
nnnnnnnnnnnnnnnnnnnnnnnnnnnnnnnnnnnnnnnnnnnnnnnnnnnnnnnnnnnnnnnnnnnnnnnnnnnnnnnnnnnnncugaguuauuaucuuuuucuu

SEQ ID NO: 3782 - DNA, 27 bp, Artificial Sequence
  Description of Artificial Sequence: Synthetic oligonucleotide
  modified_base (22)..(27): a, c, t, g, unknown or other
aagaaaaagataataactcagnnnnnn

SEQ ID NO: 3783 - DNA, 34 bp, Artificial Sequence
  Description of Artificial Sequence: Synthetic oligonucleotide
cccagaagacctgcctgatctgtggagatgaagc

SEQ ID NO: 3784 - RNA, 27 nt, Artificial Sequence
  Description of Artificial Sequence: Synthetic oligonucleotide
ugaaguuuuuaaaagcugcuaaagaac

SEQ ID NO: 3785 - RNA, 27 nt, Artificial Sequence
  Description of Artificial Sequence: Synthetic oligonucleotide
gaaguuuuuaaaagcugcuaaagacca

SEQ ID NO: 3786 - RNA, 27 nt, Artificial Sequence
  Description of Artificial Sequence: Synthetic oligonucleotide
aaguuuuuaaaagcugcuaaagacuaa

SEQ ID NO: 3787 - RNA, 27 nt, Artificial Sequence
  Description of Artificial Sequence: Synthetic oligonucleotide
ugcggagccagagaucaaaagaugacc

SEQ ID NO: 3788 - RNA, 27 nt, Artificial Sequence
  Description of Artificial Sequence: Synthetic oligonucleotide
gccagagaucaaaagaugaaaaggcca

SEQ ID NO: 3789 - RNA, 27 nt, Artificial Sequence
  Description of Artificial Sequence: Synthetic oligonucleotide
ccagagaucaaaagaugaaaaggcaac

SEQ ID NO: 3790 - RNA, 27 nt, Artificial Sequence
  Description of Artificial Sequence: Synthetic oligonucleotide
caaaagaugaaaaggcagucagguccc

SEQ ID NO: 3791 - RNA, 27 nt, Artificial Sequence
  Description of Artificial Sequence: Synthetic oligonucleotide
aaaagaugaaaaggcagucaggucuca

SEQ ID NO: 3792 - RNA, 27 nt, Artificial Sequence
  Description of Artificial Sequence: Synthetic oligonucleotide
gucaggucuucaguagccaaaaaaccc

SEQ ID NO: 3793 - RNA, 27 nt, Artificial Sequence
  Description of Artificial Sequence: Synthetic oligonucleotide
ucaggucuucaguagccaaaaaacacc

SEQ ID NO: 3794 - RNA, 27 nt, Artificial Sequence
  Description of Artificial Sequence: Synthetic oligonucleotide
caguagccaaaaaacaaaacaaacacc

SEQ ID NO: 3795 - RNA, 27 nt, Artificial Sequence
  Description of Artificial Sequence: Synthetic oligonucleotide
gccaaaaaacaaaacaaacaaaaaccc

SEQ ID NO: 3796 - RNA, 27 nt, Artificial Sequence
  Description of Artificial Sequence: Synthetic oligonucleotide
ccaaaaaacaaaacaaacaaaaacacc

SEQ ID NO: 3797 - RNA, 27 nt, Artificial Sequence
  Description of Artificial Sequence: Synthetic oligonucleotide
acaaaacaaacaaaaacaaaaaagcaa

SEQ ID NO: 3798 - RNA, 27 nt, Artificial Sequence
  Description of Artificial Sequence: Synthetic oligonucleotide
aacaaaaacaaaaaagccgaaauaacc

SEQ ID NO: 3799 - RNA, 27 nt, Artificial Sequence
  Description of Artificial Sequence: Synthetic oligonucleotide
acaaaaacaaaaaagccgaaauaaaca

SEQ ID NO: 3800 - RNA, 27 nt, Artificial Sequence
  Description of Artificial Sequence: Synthetic oligonucleotide
caaaaacaaaaaagccgaaauaaaaac

SEQ ID NO: 3801 - RNA, 27 nt, Artificial Sequence
  Description of Artificial Sequence: Synthetic oligonucleotide
acaaaaaagccgaaauaaaagaaaaca

SEQ ID NO: 3802 - RNA, 27 nt, Artificial Sequence
  Description of Artificial Sequence: Synthetic oligonucleotide
caaaaaagccgaaauaaaagaaaaaac

SEQ ID NO: 3803 - RNA, 27 nt, Artificial Sequence
  Description of Artificial Sequence: Synthetic oligonucleotide
aaaaagccgaaauaaaagaaaaagacc

SEQ ID NO: 3804 - RNA, 27 nt, Artificial Sequence
  Description of Artificial Sequence: Synthetic oligonucleotide
gccgaaauaaaagaaaaagauaauaca

SEQ ID NO: 3805 - RNA, 27 nt, Artificial Sequence
  Description of Artificial Sequence: Synthetic oligonucleotide
ccgaaauaaaagaaaaagauaauaaac

SEQ ID NO: 3806 - RNA, 27 nt, Artificial Sequence
  Description of Artificial Sequence: Synthetic oligonucleotide
cgaaauaaaagaaaaagauaauaacca

SEQ ID NO: 3807 - RNA, 27 nt, Artificial Sequence
  Description of Artificial Sequence: Synthetic oligonucleotide
aagaaaaagauaauaacucaguucucc

SEQ ID NO: 3808 - RNA, 27 nt, Artificial Sequence
  Description of Artificial Sequence: Synthetic oligonucleotide
aaaagauaauaacucaguucuuauuca

SEQ ID NO: 3809 - RNA, 27 nt, Artificial Sequence
  Description of Artificial Sequence: Synthetic oligonucleotide
aaagauaauaacucaguucuuauuuaa

SEQ ID NO: 3810 - RNA, 27 nt, Artificial Sequence
  Description of Artificial Sequence: Synthetic oligonucleotide
agauaauaacucaguucuuauuugcca

SEQ ID NO: 3811 - RNA, 27 nt, Artificial Sequence
  Description of Artificial Sequence: Synthetic oligonucleotide
gauaauaacucaguucuuauuugcaaa

SEQ ID NO: 3812 - RNA, 27 nt, Artificial Sequence
  Description of Artificial Sequence: Synthetic oligonucleotide
ucuuauuugcaccuacuucaguggaac

SEQ ID NO: 3813 - RNA, 27 nt, Artificial Sequence
  Description of Artificial Sequence: Synthetic oligonucleotide
ucaguggacacugaauuuggaagguaa

SEQ ID NO: 3814 - RNA, 27 nt, Artificial Sequence
  Description of Artificial Sequence: Synthetic oligonucleotide
cacugaauuuggaagguggaggauucc

SEQ ID NO: 3815 - RNA, 27 nt, Artificial Sequence
  Description of Artificial Sequence: Synthetic oligonucleotide
uuuggaagguggaggauuuuguuuucc

SEQ ID NO: 3816 - RNA, 27 nt, Artificial Sequence
  Description of Artificial Sequence: Synthetic oligonucleotide
ggaagguggaggauuuuguuuuuuuac

SEQ ID NO: 3817 - RNA, 27 nt, Artificial Sequence
  Description of Artificial Sequence: Synthetic oligonucleotide
uggaggauuuuguuuuuuucuuuuaca

SEQ ID NO: 3818 - RNA, 27 nt, Artificial Sequence
  Description of Artificial Sequence: Synthetic oligonucleotide
ggaggauuuuguuuuuuucuuuuaaac

SEQ ID NO: 3819 - RNA, 27 nt, Artificial Sequence
  Description of Artificial Sequence: Synthetic oligonucleotide
aggauuuuguuuuuuucuuuuaagaca

SEQ ID NO: 3820 - RNA, 27 nt, Artificial Sequence
  Description of Artificial Sequence: Synthetic oligonucleotide
ggauuuuguuuuuuucuuuuaagauac

SEQ ID NO: 3821 - RNA, 27 nt, Artificial Sequence
  Description of Artificial Sequence: Synthetic oligonucleotide
gauuuuguuuuuuucuuuuaagaucca

SEQ ID NO: 3822 - RNA, 27 nt, Artificial Sequence
  Description of Artificial Sequence: Synthetic oligonucleotide
auuuuguuuuuuucuuuuaagaucuaa

SEQ ID NO: 3823 - RNA, 27 nt, Artificial Sequence
  Description of Artificial Sequence: Synthetic oligonucleotide
uguuuuuuucuuuuaagaucugggccc

SEQ ID NO: 3824 - RNA, 27 nt, Artificial Sequence
  Description of Artificial Sequence: Synthetic oligonucleotide
guuuuuuucuuuuaagaucugggcaca

SEQ ID NO: 3825 - RNA, 27 nt, Artificial Sequence
  Description of Artificial Sequence: Synthetic oligonucleotide
uuuaagaucugggcaucuuuugaauac

SEQ ID NO: 3826 - RNA, 27 nt, Artificial Sequence
  Description of Artificial Sequence: Synthetic oligonucleotide
aucuuuugaaucuacccuucaaguacc

SEQ ID NO: 3827 - RNA, 27 nt, Artificial Sequence
  Description of Artificial Sequence: Synthetic oligonucleotide
ucuuuugaaucuacccuucaaguaucc

SEQ ID NO: 3828 - RNA, 27 nt, Artificial Sequence
  Description of Artificial Sequence: Synthetic oligonucleotide
cuuuugaaucuacccuucaaguauucc

SEQ ID NO: 3829 - RNA, 27 nt, Artificial Sequence
  Description of Artificial Sequence: Synthetic oligonucleotide
uuuugaaucuacccuucaaguauuaca

SEQ ID NO: 3830 - RNA, 27 nt, Artificial Sequence
  Description of Artificial Sequence: Synthetic oligonucleotide
uuugaaucuacccuucaaguauuaaac

SEQ ID NO: 3831 - RNA, 27 nt, Artificial Sequence
  Description of Artificial Sequence: Synthetic oligonucleotide
ucaaguauuaagagacagacugugaaa

SEQ ID NO: 3832 - RNA, 27 nt, Artificial Sequence
  Description of Artificial Sequence: Synthetic oligonucleotide
aguauuaagagacagacugugagcccc

SEQ ID NO: 3833 - RNA, 27 nt, Artificial Sequence
  Description of Artificial Sequence: Synthetic oligonucleotide
cuguugaacucuucugagcaagagaca

SEQ ID NO: 3834 - RNA, 27 nt, Artificial Sequence
  Description of Artificial Sequence: Synthetic oligonucleotide
uguugaacucuucugagcaagagaaaa

SEQ ID NO: 3835 - RNA, 27 nt, Artificial Sequence
  Description of Artificial Sequence: Synthetic oligonucleotide
caaggauggaagugcaguuagggcuaa

SEQ ID NO: 3836 - RNA, 27 nt, Artificial Sequence
  Description of Artificial Sequence: Synthetic oligonucleotide
ccgaggagcuuuccagaaucuguucac

SEQ ID NO: 3837 - RNA, 27 nt, Artificial Sequence
  Description of Artificial Sequence: Synthetic oligonucleotide
cgaggagcuuuccagaaucuguuccca

SEQ ID NO: 3838 - RNA, 27 nt, Artificial Sequence
  Description of Artificial Sequence: Synthetic oligonucleotide
cgcugaccuuaaagacauccugagcac

SEQ ID NO: 3839 - RNA, 27 nt, Artificial Sequence
  Description of Artificial Sequence: Synthetic oligonucleotide
uccaaggacaauuacuuagggggcaac

SEQ ID NO: 3840 - RNA, 27 nt, Artificial Sequence
  Description of Artificial Sequence: Synthetic oligonucleotide
ccaaggaguuguguaaggcagugucaa

SEQ ID NO: 3841 - RNA, 27 nt, Artificial Sequence
  Description of Artificial Sequence: Synthetic oligonucleotide
cacugaagauacugcugaguauuccaa

SEQ ID NO: 3842 - RNA, 27 nt, Artificial Sequence
  Description of Artificial Sequence: Synthetic oligonucleotide
ugcugaguauuccccuuucaagggaaa

SEQ ID NO: 3843 - RNA, 27 nt, Artificial Sequence
  Description of Artificial Sequence: Synthetic oligonucleotide
cacuugugucaaaagcgaaaugggcaa

SEQ ID NO: 3844 - RNA, 27 nt, Artificial Sequence
  Description of Artificial Sequence: Synthetic oligonucleotide
acuugugucaaaagcgaaaugggccaa

SEQ ID NO: 3845 - RNA, 27 nt, Artificial Sequence
  Description of Artificial Sequence: Synthetic oligonucleotide
accauguuuugcccauugacuauuaac

SEQ ID NO: 3846 - RNA, 27 nt, Artificial Sequence
  Description of Artificial Sequence: Synthetic oligonucleotide
cauguuuugcccauugacuauuacucc

SEQ ID NO: 3847 - RNA, 27 nt, Artificial Sequence
  Description of Artificial Sequence: Synthetic oligonucleotide
cuguggagaugaagcuucuggguguac

SEQ ID NO: 3848 - RNA, 27 nt, Artificial Sequence
  Description of Artificial Sequence: Synthetic oligonucleotide
ugaagggaaacagaaguaccugugcaa

SEQ ID NO: 3849 - RNA, 27 nt, Artificial Sequence
  Description of Artificial Sequence: Synthetic oligonucleotide
gcagaaaugauugcacuauugauaacc

SEQ ID NO: 3850 - RNA, 27 nt, Artificial Sequence
  Description of Artificial Sequence: Synthetic oligonucleotide
cagaaaugauugcacuauugauaaacc

SEQ ID NO: 3851 - RNA, 27 nt, Artificial Sequence
  Description of Artificial Sequence: Synthetic oligonucleotide
agaaaugauugcacuauugauaaauca

SEQ ID NO: 3852 - RNA, 27 nt, Artificial Sequence
  Description of Artificial Sequence: Synthetic oligonucleotide
aaaugauugcacuauugauaaauucaa

SEQ ID NO: 3853 - RNA, 27 nt, Artificial Sequence
  Description of Artificial Sequence: Synthetic oligonucleotide
aaugauugcacuauugauaaauuccac

SEQ ID NO: 3854 - RNA, 27 nt, Artificial Sequence
  Description of Artificial Sequence: Synthetic oligonucleotide
cacuauugauaaauuccgaaggaaacc

SEQ ID NO: 3855 - RNA, 27 nt, Artificial Sequence
  Description of Artificial Sequence: Synthetic oligonucleotide
acuauugauaaauuccgaaggaaaacc

SEQ ID NO: 3856 - RNA, 27 nt, Artificial Sequence
  Description of Artificial Sequence: Synthetic oligonucleotide
cuauugauaaauuccgaaggaaaaacc

SEQ ID NO: 3857 - RNA, 27 nt, Artificial Sequence
  Description of Artificial Sequence: Synthetic oligonucleotide
uauugauaaauuccgaaggaaaaauca

SEQ ID NO: 3858 - RNA, 27 nt, Artificial Sequence
  Description of Artificial Sequence: Synthetic oligonucleotide
auugauaaauuccgaaggaaaaauuac

SEQ ID NO: 3859 - RNA, 27 nt, Artificial Sequence
  Description of Artificial Sequence: Synthetic oligonucleotide
ugauaaauuccgaaggaaaaauuguaa

SEQ ID NO: 3860 - RNA, 27 nt, Artificial Sequence
  Description of Artificial Sequence: Synthetic oligonucleotide
gauaaauuccgaaggaaaaauugucac

SEQ ID NO: 3861 - RNA, 27 nt, Artificial Sequence
  Description of Artificial Sequence: Synthetic oligonucleotide
cgaaggaaaaauuguccaucuugucac

SEQ ID NO: 3862 - RNA, 27 nt, Artificial Sequence
  Description of Artificial Sequence: Synthetic oligonucleotide
aucuugucgucuucggaaauguuauac

SEQ ID NO: 3863 - RNA, 27 nt, Artificial Sequence
  Description of Artificial Sequence: Synthetic oligonucleotide
cggaaauguuaugaagcagggaugaac

SEQ ID NO: 3864 - RNA, 27 nt, Artificial Sequence
  Description of Artificial Sequence: Synthetic oligonucleotide
gaaauguuaugaagcagggaugacuac

SEQ ID NO: 3865 - RNA, 27 nt, Artificial Sequence
  Description of Artificial Sequence: Synthetic oligonucleotide
cccggaagcugaagaaacuugguaaca

SEQ ID NO: 3866 - RNA, 27 nt, Artificial Sequence
  Description of Artificial Sequence: Synthetic oligonucleotide
cggaagcugaagaaacuugguaaucca

SEQ ID NO: 3867 - RNA, 27 nt, Artificial Sequence
  Description of Artificial Sequence: Synthetic oligonucleotide
gcugaagaaacuugguaaucugaaaac

SEQ ID NO: 3868 - RNA, 27 nt, Artificial Sequence
  Description of Artificial Sequence: Synthetic oligonucleotide
cugaagaaacuugguaaucugaaaccc

SEQ ID NO: 3869 - RNA, 27 nt, Artificial Sequence
  Description of Artificial Sequence: Synthetic oligonucleotide
ugaagaaacuugguaaucugaaacuca

SEQ ID NO: 3870 - RNA, 27 nt, Artificial Sequence
  Description of Artificial Sequence: Synthetic oligonucleotide
uugguaaucugaaacuacaggaggaca

SEQ ID NO: 3871 - RNA, 27 nt, Artificial Sequence
  Description of Artificial Sequence: Synthetic oligonucleotide
aucugaaacuacaggaggaaggagaaa

SEQ ID NO: 3872 - RNA, 27 nt, Artificial Sequence
  Description of Artificial Sequence: Synthetic oligonucleotide
cccaggaauuccugugcaugaaagcca

SEQ ID NO: 3873 - RNA, 27 nt, Artificial Sequence
  Description of Artificial Sequence: Synthetic oligonucleotide
ccaggaauuccugugcaugaaagcaac

SEQ ID NO: 3874 - RNA, 27 nt, Artificial Sequence
  Description of Artificial Sequence: Synthetic oligonucleotide
guggaugggcugaaaaaucaaaaauca

SEQ ID NO: 3875 - RNA, 27 nt, Artificial Sequence
  Description of Artificial Sequence: Synthetic oligonucleotide
uggaugggcugaaaaaucaaaaauuac

SEQ ID NO: 3876 - RNA, 27 nt, Artificial Sequence
  Description of Artificial Sequence: Synthetic oligonucleotide
gaugggcugaaaaaucaaaaauucucc

SEQ ID NO: 3877 - RNA, 27 nt, Artificial Sequence
  Description of Artificial Sequence: Synthetic oligonucleotide
ggcugaaaaaucaaaaauucuuugaca

SEQ ID NO: 3878 - RNA, 27 nt, Artificial Sequence
  Description of Artificial Sequence: Synthetic oligonucleotide
gcugaaaaaucaaaaauucuuugauac

SEQ ID NO: 3879 - RNA, 27 nt, Artificial Sequence
  Description of Artificial Sequence: Synthetic oligonucleotide
ugaaaaaucaaaaauucuuugaugaca

SEQ ID NO: 3880 - RNA, 27 nt, Artificial Sequence
  Description of Artificial Sequence: Synthetic oligonucleotide
gaaaaaucaaaaauucuuugaugaaac

SEQ ID NO: 3881 - RNA, 27 nt, Artificial Sequence
  Description of Artificial Sequence: Synthetic oligonucleotide
aaaaaucaaaaauucuuugaugaaccc

SEQ ID NO: 3882 - RNA, 27 nt, Artificial Sequence
  Description of Artificial Sequence: Synthetic oligonucleotide
uucgaaugaacuacaucaaggaacuaa

SEQ ID NO: 3883 - RNA, 27 nt, Artificial Sequence
  Description of Artificial Sequence: Synthetic oligonucleotide
ucaaggaacucgaucguaucauugccc

SEQ ID NO: 3884 - RNA, 27 nt, Artificial Sequence
  Description of Artificial Sequence: Synthetic oligonucleotide
caaggaacucgaucguaucauugcaca

SEQ ID NO: 3885 - RNA, 27 nt, Artificial Sequence
  Description of Artificial Sequence: Synthetic oligonucleotide
aucguaucauugcaugcaaaagaaacc

SEQ ID NO: 3886 - RNA, 27 nt, Artificial Sequence
  Description of Artificial Sequence: Synthetic oligonucleotide
ucguaucauugcaugcaaaagaaaacc

SEQ ID NO: 3887 - RNA, 27 nt, Artificial Sequence
  Description of Artificial Sequence: Synthetic oligonucleotide
aucauugcaugcaaaagaaaaaaucaa

SEQ ID NO: 3888 - RNA, 27 nt, Artificial Sequence
  Description of Artificial Sequence: Synthetic oligonucleotide
cacuuuugaccugcuaaucaagucaac

SEQ ID NO: 3889 - RNA, 27 nt, Artificial Sequence
  Description of Artificial Sequence: Synthetic oligonucleotide
gcguggacuuuccggaaaugauggcca

SEQ ID NO: 3890 - RNA, 27 nt, Artificial Sequence
  Description of Artificial Sequence: Synthetic oligonucleotide
cguggacuuuccggaaaugauggcaac

SEQ ID NO: 3891 - RNA, 27 nt, Artificial Sequence
  Description of Artificial Sequence: Synthetic oligonucleotide
ugauggcagagaucaucucugugcaca

SEQ ID NO: 3892 - RNA, 27 nt, Artificial Sequence
  Description of Artificial Sequence: Synthetic oligonucleotide
gcagagaucaucucugugcaagugcaa

SEQ ID NO: 3893 - RNA, 27 nt, Artificial Sequence
  Description of Artificial Sequence: Synthetic oligonucleotide
cagagaucaucucugugcaagugccac

SEQ ID NO: 3894 - RNA, 27 nt, Artificial Sequence
  Description of Artificial Sequence: Synthetic oligonucleotide
cccaagauccuuucugggaaagucaca

SEQ ID NO: 3895 - RNA, 27 nt, Artificial Sequence
  Description of Artificial Sequence: Synthetic oligonucleotide
gugaagcauuggaaacccuauuuccaa

SEQ ID NO: 3896 - RNA, 27 nt, Artificial Sequence
  Description of Artificial Sequence: Synthetic oligonucleotide
cagaugucuucugccuguuauaacuac

SEQ ID NO: 3897 - RNA, 27 nt, Artificial Sequence
  Description of Artificial Sequence: Synthetic oligonucleotide
gccuuggggaauuuccucuauugauac

SEQ ID NO: 3898 - RNA, 27 nt, Artificial Sequence
  Description of Artificial Sequence: Synthetic oligonucleotide
cuuggggaauuuccucuauugauguca

SEQ ID NO: 3899 - RNA, 27 nt, Artificial Sequence
  Description of Artificial Sequence: Synthetic oligonucleotide
uuggggaauuuccucuauugauguaac

SEQ ID NO: 3900 - RNA, 27 nt, Artificial Sequence
  Description of Artificial Sequence: Synthetic oligonucleotide
uggggaauuuccucuauugauguacca

SEQ ID NO: 3901 - RNA, 27 nt, Artificial Sequence
  Description of Artificial Sequence: Synthetic oligonucleotide
ggggaauuuccucuauugauguacaac

SEQ ID NO: 3902 - RNA, 27 nt, Artificial Sequence
  Description of Artificial Sequence: Synthetic oligonucleotide
cuauugauguacagucugucaugaaac

SEQ ID NO: 3903 - RNA, 27 nt, Artificial Sequence
  Description of Artificial Sequence: Synthetic oligonucleotide
uauugauguacagucugucaugaaccc

SEQ ID NO: 3904 - RNA, 27 nt, Artificial Sequence
  Description of Artificial Sequence: Synthetic oligonucleotide
auugauguacagucugucaugaacaca

SEQ ID NO: 3905 - RNA, 27 nt, Artificial Sequence
  Description of Artificial Sequence: Synthetic oligonucleotide
aacauguuccugaauucuauuugcuaa

SEQ ID NO: 3906 - RNA, 27 nt, Artificial Sequence
  Description of Artificial Sequence: Synthetic oligonucleotide
uucuauuugcugggcuuuuuuuuucca

SEQ ID NO: 3907 - RNA, 27 nt, Artificial Sequence
  Description of Artificial Sequence: Synthetic oligonucleotide
ucuauuugcugggcuuuuuuuuucuac

SEQ ID NO: 3908 - RNA, 27 nt, Artificial Sequence
  Description of Artificial Sequence: Synthetic oligonucleotide
ugcugggcuuuuuuuuucucuuucuac

SEQ ID NO: 3909 - RNA, 27 nt, Artificial Sequence
  Description of Artificial Sequence: Synthetic oligonucleotide
uuuuuuuucucuuucucuccuuucucc

SEQ ID NO: 3910 - RNA, 27 nt, Artificial Sequence
  Description of Artificial Sequence: Synthetic oligonucleotide
uucagacuuugcuucccauuguggcca

SEQ ID NO: 3911 - RNA, 27 nt, Artificial Sequence
  Description of Artificial Sequence: Synthetic oligonucleotide
uuguggcuccuaucuguguuuugaaca

SEQ ID NO: 3912 - RNA, 27 nt, Artificial Sequence
  Description of Artificial Sequence: Synthetic oligonucleotide
uccuaucuguguuuugaaugguguuac

SEQ ID NO: 3913 - RNA, 27 nt, Artificial Sequence
  Description of Artificial Sequence: Synthetic oligonucleotide
aucuguguuuugaaugguguuguauaa

SEQ ID NO: 3914 - RNA, 27 nt, Artificial Sequence
  Description of Artificial Sequence: Synthetic oligonucleotide
uguguuuugaaugguguuguaugcccc

SEQ ID NO: 3915 - RNA, 27 nt, Artificial Sequence
  Description of Artificial Sequence: Synthetic oligonucleotide
ugaaugguguuguaugccuuuaaauac

SEQ ID NO: 3916 - RNA, 27 nt, Artificial Sequence
  Description of Artificial Sequence: Synthetic oligonucleotide
gaaugguguuguaugccuuuaaaucca

SEQ ID NO: 3917 - RNA, 27 nt, Artificial Sequence
  Description of Artificial Sequence: Synthetic oligonucleotide
uguuguaugccuuuaaaucugugauac

SEQ ID NO: 3918 - RNA, 27 nt, Artificial Sequence
  Description of Artificial Sequence: Synthetic oligonucleotide
uuguaugccuuuaaaucugugaugaca

SEQ ID NO: 3919 - RNA, 27 nt, Artificial Sequence
  Description of Artificial Sequence: Synthetic oligonucleotide
uguaugccuuuaaaucugugaugauaa

SEQ ID NO: 3920 - RNA, 27 nt, Artificial Sequence
  Description of Artificial Sequence: Synthetic oligonucleotide
cccagugucaaguugugcuuguuuaac

SEQ ID NO: 3921 - RNA, 27 nt, Artificial Sequence
  Description of Artificial Sequence: Synthetic oligonucleotide
ccagugucaaguugugcuuguuuacca

SEQ ID NO: 3922 - RNA, 27 nt, Artificial Sequence
  Description of Artificial Sequence: Synthetic oligonucleotide
gcuuguuuacagcacuacucugugcac

SEQ ID NO: 3923 - RNA, 27 nt, Artificial Sequence
  Description of Artificial Sequence: Synthetic oligonucleotide
cuuguuuacagcacuacucugugccca

SEQ ID NO: 3924 - RNA, 27 nt, Artificial Sequence
  Description of Artificial Sequence: Synthetic oligonucleotide
cacaaacguuuacuuaucuuaugccca

SEQ ID NO: 3925 - RNA, 27 nt, Artificial Sequence
  Description of Artificial Sequence: Synthetic oligonucleotide
cacgggaaguuuagagagcuaagaucc

SEQ ID NO: 3926 - RNA, 27 nt, Artificial Sequence
  Description of Artificial Sequence: Synthetic oligonucleotide
acgggaaguuuagagagcuaagauucc

SEQ ID NO: 3927 - RNA, 27 nt, Artificial Sequence
  Description of Artificial Sequence: Synthetic oligonucleotide
cgggaaguuuagagagcuaagauuaca

SEQ ID NO: 3928 - RNA, 27 nt, Artificial Sequence
  Description of Artificial Sequence: Synthetic oligonucleotide
gggaaguuuagagagcuaagauuauac

SEQ ID NO: 3929 - RNA, 27 nt, Artificial Sequence
  Description of Artificial Sequence: Synthetic oligonucleotide
gaaguuuagagagcuaagauuaucuaa

SEQ ID NO: 3930 - RNA, 27 nt, Artificial Sequence
  Description of Artificial Sequence: Synthetic oligonucleotide
uuagagagcuaagauuaucuggggacc

SEQ ID NO: 3931 - RNA, 27 nt, Artificial Sequence
  Description of Artificial Sequence: Synthetic oligonucleotide
uagagagcuaagauuaucuggggaacc

SEQ ID NO: 3932 - RNA, 27 nt, Artificial Sequence
  Description of Artificial Sequence: Synthetic oligonucleotide
agagagcuaagauuaucuggggaaaca

SEQ ID NO: 3933 - RNA, 27 nt, Artificial Sequence
  Description of Artificial Sequence: Synthetic oligonucleotide
uaagauuaucuggggaaaucaaaaccc

SEQ ID NO: 3934 - RNA, 27 nt, Artificial Sequence
  Description of Artificial Sequence: Synthetic oligonucleotide
aagauuaucuggggaaaucaaaacacc

SEQ ID NO: 3935 - RNA, 27 nt, Artificial Sequence
  Description of Artificial Sequence: Synthetic oligonucleotide
aucuggggaaaucaaaacaaaaacaca

SEQ ID NO: 3936 - RNA, 27 nt, Artificial Sequence
  Description of Artificial Sequence: Synthetic oligonucleotide
ggggaaaucaaaacaaaaacaagcacc

SEQ ID NO: 3937 - RNA, 27 nt, Artificial Sequence
  Description of Artificial Sequence: Synthetic oligonucleotide
gugaaguuuuuaaaagcugcuaaagca

SEQ ID NO: 3938 - RNA, 27 nt, Artificial Sequence
  Description of Artificial Sequence: Synthetic oligonucleotide
agcuagcugcacauugcaaagaaggac

SEQ ID NO: 3939 - RNA, 27 nt, Artificial Sequence
  Description of Artificial Sequence: Synthetic oligonucleotide
acauugcaaagaaggcucuuaggagaa

SEQ ID NO: 3940 - RNA, 27 nt, Artificial Sequence
  Description of Artificial Sequence: Synthetic oligonucleotide
aacaaaacaaacaaaaacaaaaaagaa

SEQ ID NO: 3941 - RNA, 27 nt, Artificial Sequence
  Description of Artificial Sequence: Synthetic oligonucleotide
aagauaauaacucaguucuuauuugac

SEQ ID NO: 3942 - RNA, 27 nt, Artificial Sequence
  Description of Artificial Sequence: Synthetic oligonucleotide
uucaguggacacugaauuuggaaggca

SEQ ID NO: 3943 - RNA, 27 nt, Artificial Sequence
  Description of Artificial Sequence: Synthetic oligonucleotide
caguggacacugaauuuggaaggugac

SEQ ID NO: 3944 - RNA, 27 nt, Artificial Sequence
  Description of Artificial Sequence: Synthetic oligonucleotide
aguggacacugaauuuggaagguggca

SEQ ID NO: 3945 - RNA, 27 nt, Artificial Sequence
  Description of Artificial Sequence: Synthetic oligonucleotide
uugaaucuacccuucaaguauuaagca

SEQ ID NO: 3946 - RNA, 27 nt, Artificial Sequence
  Description of Artificial Sequence: Synthetic oligonucleotide
caaguauuaagagacagacugugagaa

SEQ ID NO: 3947 - RNA, 27 nt, Artificial Sequence
  Description of Artificial Sequence: Synthetic oligonucleotide
gcugaguauuccccuuucaagggagac

SEQ ID NO: 3948 - RNA, 27 nt, Artificial Sequence
  Description of Artificial Sequence: Synthetic oligonucleotide
cugaguauuccccuuucaagggaggcc

SEQ ID NO: 3949 - RNA, 27 nt, Artificial Sequence
  Description of Artificial Sequence: Synthetic oligonucleotide
ucuguggagaugaagcuucugggugca

SEQ ID NO: 3950 - RNA, 27 nt, Artificial Sequence
  Description of Artificial Sequence: Synthetic oligonucleotide
gaagggaaacagaaguaccugugcgaa

SEQ ID NO: 3951 - RNA, 27 nt, Artificial Sequence
  Description of Artificial Sequence: Synthetic oligonucleotide
uugauaaauuccgaaggaaaaauugca

SEQ ID NO: 3952 - RNA, 27 nt, Artificial Sequence
  Description of Artificial Sequence: Synthetic oligonucleotide
gaaggaaaaauuguccaucuugucgca

SEQ ID NO: 3953 - RNA, 27 nt, Artificial Sequence
  Description of Artificial Sequence: Synthetic oligonucleotide
ucggaaauguuaugaagcagggaugca

SEQ ID NO: 3954 - RNA, 27 nt, Artificial Sequence
  Description of Artificial Sequence: Synthetic oligonucleotide
acuugguaaucugaaacuacaggagac

SEQ ID NO: 3955 - RNA, 27 nt, Artificial Sequence
  Description of Artificial Sequence: Synthetic oligonucleotide
cuugguaaucugaaacuacaggaggcc

SEQ ID NO: 3956 - RNA, 27 nt, Artificial Sequence
  Description of Artificial Sequence: Synthetic oligonucleotide
gguaaucugaaacuacaggaggaagac

SEQ ID NO: 3957 - RNA, 27 nt, Artificial Sequence
  Description of Artificial Sequence: Synthetic oligonucleotide
agcugacagugucacacauugaaggac

SEQ ID NO: 3958 - RNA, 27 nt, Artificial Sequence
  Description of Artificial Sequence: Synthetic oligonucleotide
ggcugucauucaguacuccuggaugaa

SEQ ID NO: 3959 - RNA, 27 nt, Artificial Sequence
  Description of Artificial Sequence: Synthetic oligonucleotide
cugaaaaaucaaaaauucuuugaugcc

SEQ ID NO: 3960 - RNA, 27 nt, Artificial Sequence
  Description of Artificial Sequence: Synthetic oligonucleotide
aaaauucuuugaugaacuucgaaugcc

SEQ ID NO: 3961 - RNA, 27 nt, Artificial Sequence
  Description of Artificial Sequence: Synthetic oligonucleotide
ugcuaaucaagucacacauggugagaa

SEQ ID NO: 3962 - RNA, 27 nt, Artificial Sequence
  Description of Artificial Sequence: Synthetic oligonucleotide
agcguggacuuuccggaaaugauggac

SEQ ID NO: 3963 - RNA, 27 nt, Artificial Sequence
  Description of Artificial Sequence: Synthetic oligonucleotide
ccuuggggaauuuccucuauugaugcc

SEQ ID NO: 3964 - RNA, 27 nt, Artificial Sequence
  Description of Artificial Sequence: Synthetic oligonucleotide
ucuguguuuugaaugguguuguaugaa

SEQ ID NO: 3965 - RNA, 27 nt, Artificial Sequence
  Description of Artificial Sequence: Synthetic oligonucleotide
guuguaugccuuuaaaucugugaugcc

SEQ ID NO: 3966 - RNA, 27 nt, Artificial Sequence
  Description of Artificial Sequence: Synthetic oligonucleotide
uuuagagagcuaagauuaucuggggcc

SEQ ID NO: 3967 - RNA, 27 nt, Artificial Sequence
  Description of Artificial Sequence: Synthetic oligonucleotide
ucggugaaguuuuuaaaagcugcuacc

SEQ ID NO: 3968 - RNA, 27 nt, Artificial Sequence
  Description of Artificial Sequence: Synthetic oligonucleotide
aguuuuuaaaagcugcuaaagacucaa

SEQ ID NO: 3969 - RNA, 27 nt, Artificial Sequence
  Description of Artificial Sequence: Synthetic oligonucleotide
gcagagagguaacucccuuuggcugaa

SEQ ID NO: 3970 - RNA, 27 nt, Artificial Sequence
  Description of Artificial Sequence: Synthetic oligonucleotide
cagagaucaaaagaugaaaaggcagca

SEQ ID NO: 3971 - RNA, 27 nt, Artificial Sequence
  Description of Artificial Sequence: Synthetic oligonucleotide
caaaaaacaaaacaaacaaaaacaacc

SEQ ID NO: 3972 - RNA, 27 nt, Artificial Sequence
  Description of Artificial Sequence: Synthetic oligonucleotide
aaauaaaagaaaaagauaauaacucca

SEQ ID NO: 3973 - RNA, 27 nt, Artificial Sequence
  Description of Artificial Sequence: Synthetic oligonucleotide
agaaaaagauaauaacucaguucuucc

SEQ ID NO: 3974 - RNA, 27 nt, Artificial Sequence
  Description of Artificial Sequence: Synthetic oligonucleotide
auaauaacucaguucuuauuugcacac

SEQ ID NO: 3975 - RNA, 27 nt, Artificial Sequence
  Description of Artificial Sequence: Synthetic oligonucleotide
agguggaggauuuuguuuuuuucuucc

SEQ ID NO: 3976 - RNA, 27 nt, Artificial Sequence
  Description of Artificial Sequence: Synthetic oligonucleotide
uuuuguuuuuuucuuuuaagaucugaa

SEQ ID NO: 3977 - RNA, 27 nt, Artificial Sequence
  Description of Artificial Sequence: Synthetic oligonucleotide
uuuuuuucuuuuaagaucugggcauac

SEQ ID NO: 3978 - RNA, 27 nt, Artificial Sequence
  Description of Artificial Sequence: Synthetic oligonucleotide
aucugggcaucuuuugaaucuaccccc

SEQ ID NO: 3979 - RNA, 27 nt, Artificial Sequence
  Description of Artificial Sequence: Synthetic oligonucleotide
uaagggaaguagguggaagauucagaa

SEQ ID NO: 3980 - RNA, 27 nt, Artificial Sequence
  Description of Artificial Sequence: Synthetic oligonucleotide
gaggagcuuuccagaaucuguuccaac

SEQ ID NO: 3981 - RNA, 27 nt, Artificial Sequence
  Description of Artificial Sequence: Synthetic oligonucleotide
agcaggaagcaguauccgaaggcagac

SEQ ID NO: 3982 - RNA, 27 nt, Artificial Sequence
  Description of Artificial Sequence: Synthetic oligonucleotide
ccaaggacaauuacuuagggggcaccc

SEQ ID NO: 3983 - RNA, 27 nt, Artificial Sequence
  Description of Artificial Sequence: Synthetic oligonucleotide
aaggaguuguguaaggcagugucggca

SEQ ID NO: 3984 - RNA, 27 nt, Artificial Sequence
  Description of Artificial Sequence: Synthetic oligonucleotide
ggcaagagcacugaagauacugcugca

SEQ ID NO: 3985 - RNA, 27 nt, Artificial Sequence
  Description of Artificial Sequence: Synthetic oligonucleotide
acugaagauacugcugaguauucccac

SEQ ID NO: 3986 - RNA, 27 nt, Artificial Sequence
  Description of Artificial Sequence: Synthetic oligonucleotide
caagggagguuacaccaaagggcuaac

SEQ ID NO: 3987 - RNA, 27 nt, Artificial Sequence
  Description of Artificial Sequence: Synthetic oligonucleotide
cuugugucaaaagcgaaaugggcccac

SEQ ID NO: 3988 - RNA, 27 nt, Artificial Sequence
  Description of Artificial Sequence: Synthetic oligonucleotide
auguuuugcccauugacuauuacuuca

SEQ ID NO: 3989 - RNA, 27 nt, Artificial Sequence
  Description of Artificial Sequence: Synthetic oligonucleotide
ugcaaggucuucuucaaaagagccgac

SEQ ID NO: 3990 - RNA, 27 nt, Artificial Sequence
  Description of Artificial Sequence: Synthetic oligonucleotide
aagggaaacagaaguaccugugcgcac

SEQ ID NO: 3991 - RNA, 27 nt, Artificial Sequence
  Description of Artificial Sequence: Synthetic oligonucleotide
augauugcacuauugauaaauuccgcc

SEQ ID NO: 3992 - RNA, 27 nt, Artificial Sequence
  Description of Artificial Sequence: Synthetic oligonucleotide
uaaauuccgaaggaaaaauuguccaca

SEQ ID NO: 3993 - RNA, 27 nt, Artificial Sequence
  Description of Artificial Sequence: Synthetic oligonucleotide
aaggaaaaauuguccaucuugucguac

SEQ ID NO: 3994 - RNA, 27 nt, Artificial Sequence
  Description of Artificial Sequence: Synthetic oligonucleotide
gaaaaauuguccaucuugucgucuuaa

SEQ ID NO: 3995 - RNA, 27 nt, Artificial Sequence
  Description of Artificial Sequence: Synthetic oligonucleotide
gaagaaacuugguaaucugaaacuaac

SEQ ID NO: 3996 - RNA, 27 nt, Artificial Sequence
  Description of Artificial Sequence: Synthetic oligonucleotide
cauugaaggcuaugaaugucagccccc

SEQ ID NO: 3997 - RNA, 27 nt, Artificial Sequence
  Description of Artificial Sequence: Synthetic oligonucleotide
caggaauuccugugcaugaaagcacca

SEQ ID NO: 3998 - RNA, 27 nt, Artificial Sequence
  Description of Artificial Sequence: Synthetic oligonucleotide
ucaaaaauucuuugaugaacuucgacc

SEQ ID NO: 3999 - RNA, 27 nt, Artificial Sequence
  Description of Artificial Sequence: Synthetic oligonucleotide
ucuuugaugaacuucgaaugaacuaac

SEQ ID NO: 4000 - RNA, 27 nt, Artificial Sequence
  Description of Artificial Sequence: Synthetic oligonucleotide
uugaugaacuucgaaugaacuacauac

SEQ ID NO: 4001 - RNA, 27 nt, Artificial Sequence
  Description of Artificial Sequence: Synthetic oligonucleotide
ucgaaugaacuacaucaaggaacucac

SEQ ID NO: 4002 - RNA, 27 nt, Artificial Sequence
  Description of Artificial Sequence: Synthetic oligonucleotide
ugcaaaagaaaaaaucccacauccuaa

SEQ ID NO: 4003 - RNA, 27 nt, Artificial Sequence
  Description of Artificial Sequence: Synthetic oligonucleotide
aaagaaaaaaucccacauccugcuccc

SEQ ID NO: 4004 - RNA, 27 nt, Artificial Sequence
  Description of Artificial Sequence: Synthetic oligonucleotide
acuuuugaccugcuaaucaagucacca

SEQ ID NO: 4005 - RNA, 27 nt, Artificial Sequence
  Description of Artificial Sequence: Synthetic oligonucleotide
ccaagauccuuucugggaaagucaaaa

SEQ ID NO: 4006 - RNA, 27 nt, Artificial Sequence
  Description of Artificial Sequence: Synthetic oligonucleotide
ggaaagucaagcccaucuauuuccaac

SEQ ID NO: 4007 - RNA, 27 nt, Artificial Sequence
  Description of Artificial Sequence: Synthetic oligonucleotide
agaugucuucugccuguuauaacucca

SEQ ID NO: 4008 - RNA, 27 nt, Artificial Sequence
  Description of Artificial Sequence: Synthetic oligonucleotide
gggaauuuccucuauugauguacagca

SEQ ID NO: 4009 - RNA, 27 nt, Artificial Sequence
  Description of Artificial Sequence: Synthetic oligonucleotide
uugauguacagucugucaugaacauac

SEQ ID NO: 4010 - RNA, 27 nt, Artificial Sequence
  Description of Artificial Sequence: Synthetic oligonucleotide
uacagucugucaugaacauguuccuac

SEQ ID NO: 4011 - RNA, 27 nt, Artificial Sequence
  Description of Artificial Sequence: Synthetic oligonucleotide
gucaugaacauguuccugaauucuacc

SEQ ID NO: 4012 - RNA, 27 nt, Artificial Sequence
  Description of Artificial Sequence: Synthetic oligonucleotide
acauguuccugaauucuauuugcugaa

SEQ ID NO: 4013 - RNA, 27 nt, Artificial Sequence
  Description of Artificial Sequence: Synthetic oligonucleotide
gcugggcuuuuuuuuucucuuucucca

SEQ ID NO: 4014 - RNA, 27 nt, Artificial Sequence
  Description of Artificial Sequence: Synthetic oligonucleotide
uuuuuuucucuuucucuccuuucuucc

SEQ ID NO: 4015 - RNA, 27 nt, Artificial Sequence
  Description of Artificial Sequence: Synthetic oligonucleotide
guguuuugaaugguguuguaugccucc

SEQ ID NO: 4016 - RNA, 27 nt, Artificial Sequence
  Description of Artificial Sequence: Synthetic oligonucleotide
augguguuguaugccuuuaaaucugca

SEQ ID NO: 4017 - RNA, 27 nt, Artificial Sequence
  Description of Artificial Sequence: Synthetic oligonucleotide
gucaaguugugcuuguuuacagcaccc

SEQ ID NO: 4018 - RNA, 27 nt, Artificial Sequence
  Description of Artificial Sequence: Synthetic oligonucleotide
agcuaagauuaucuggggaaaucaacc

SEQ ID NO: 4019 - RNA, 27 nt, Artificial Sequence
  Description of Artificial Sequence: Synthetic oligonucleotide
ucuggggaaaucaaaacaaaaacaaaa

SEQ ID NO: 4020 - RNA, 27 nt, Artificial Sequence
  Description of Artificial Sequence: Synthetic oligonucleotide
gggaaaucaaaacaaaaacaagcaaca

SEQ ID NO: 4021 - RNA, 27 nt, Artificial Sequence
  Description of Artificial Sequence: Synthetic oligonucleotide
cggugaaguuuuuaaaagcugcuaaca

SEQ ID NO: 4022 - RNA, 27 nt, Artificial Sequence
  Description of Artificial Sequence: Synthetic oligonucleotide
guuuuuaaaagcugcuaaagacucgac

SEQ ID NO: 4023 - RNA, 27 nt, Artificial Sequence
  Description of Artificial Sequence: Synthetic oligonucleotide
uuuuaaaagcugcuaaagacucggaaa

SEQ ID NO: 4024 - RNA, 27 nt, Artificial Sequence
  Description of Artificial Sequence: Synthetic oligonucleotide
gcggagagaacccucuguuuuccccac

SEQ ID NO: 4025 - RNA, 27 nt, Artificial Sequence
  Description of Artificial Sequence: Synthetic oligonucleotide
agagaucaaaagaugaaaaggcaguac

SEQ ID NO: 4026 - RNA, 27 nt, Artificial Sequence
  Description of Artificial Sequence: Synthetic oligonucleotide
aucaaaagaugaaaaggcagucaggca

SEQ ID NO: 4027 - RNA, 27 nt, Artificial Sequence
  Description of Artificial Sequence: Synthetic oligonucleotide
uucaguagccaaaaaacaaaacaaaac

SEQ ID NO: 4028 - RNA, 27 nt, Artificial Sequence
  Description of Artificial Sequence: Synthetic oligonucleotide
aaaaaacaaaacaaacaaaaacaaacc

SEQ ID NO: 4029 - RNA, 27 nt, Artificial Sequence
  Description of Artificial Sequence: Synthetic oligonucleotide
aauaaaagaaaaagauaauaacucaac

SEQ ID NO: 4030 - RNA, 27 nt, Artificial Sequence
  Description of Artificial Sequence: Synthetic oligonucleotide
uaaaagaaaaagauaauaacucaguca

SEQ ID NO: 4031 - RNA, 27 nt, Artificial Sequence
  Description of Artificial Sequence: Synthetic oligonucleotide
gaaaaagauaauaacucaguucuuacc

SEQ ID NO: 4032 - RNA, 27 nt, Artificial Sequence
  Description of Artificial Sequence: Synthetic oligonucleotide
uaauaacucaguucuuauuugcacccc

SEQ ID NO: 4033 - RNA, 27 nt, Artificial Sequence
  Description of Artificial Sequence: Synthetic oligonucleotide
cucaguucuuauuugcaccuacuucca

SEQ ID NO: 4034 - RNA, 27 nt, Artificial Sequence
  Description of Artificial Sequence: Synthetic oligonucleotide
gguggaggauuuuguuuuuuucuuucc

SEQ ID NO: 4035 - RNA, 27 nt, Artificial Sequence
  Description of Artificial Sequence: Synthetic oligonucleotide
uuuguuuuuuucuuuuaagaucuggaa

SEQ ID NO: 4036 - RNA, 27 nt, Artificial Sequence
  Description of Artificial Sequence: Synthetic oligonucleotide
uuuuuucuuuuaagaucugggcauccc

SEQ ID NO: 4037 - RNA, 27 nt, Artificial Sequence
  Description of Artificial Sequence: Synthetic oligonucleotide
ucugggcaucuuuugaaucuacccuca

SEQ ID NO: 4038 - RNA, 27 nt, Artificial Sequence
  Description of Artificial Sequence: Synthetic oligonucleotide
cgcaaguuuccuucucuggagcuucaa

SEQ ID NO: 4039 - RNA, 27 nt, Artificial Sequence
  Description of Artificial Sequence: Synthetic oligonucleotide
aagggaaguagguggaagauucagcac

SEQ ID NO: 4040 - RNA, 27 nt, Artificial Sequence
  Description of Artificial Sequence: Synthetic oligonucleotide
ggaaguagguggaagauucagccaaaa

SEQ ID NO: 4041 - RNA, 27 nt, Artificial Sequence
  Description of Artificial Sequence: Synthetic oligonucleotide
caaggacaauuacuuagggggcacuca

SEQ ID NO: 4042 - RNA, 27 nt, Artificial Sequence
  Description of Artificial Sequence: Synthetic oligonucleotide
gccgaaugcaaagguucucugcuagca

SEQ ID NO: 4043 - RNA, 27 nt, Artificial Sequence
  Description of Artificial Sequence: Synthetic oligonucleotide
gcaagagcacugaagauacugcugaac

SEQ ID NO: 4044 - RNA, 27 nt, Artificial Sequence
  Description of Artificial Sequence: Synthetic oligonucleotide
cugaagauacugcugaguauucccccc

SEQ ID NO: 4045 - RNA, 27 nt, Artificial Sequence
  Description of Artificial Sequence: Synthetic oligonucleotide
uugugucaaaagcgaaaugggccccca

SEQ ID NO: 4046 - RNA, 27 nt, Artificial Sequence
  Description of Artificial Sequence: Synthetic oligonucleotide
uguuuugcccauugacuauuacuuuaa

SEQ ID NO: 4047 - RNA, 27 nt, Artificial Sequence
  Description of Artificial Sequence: Synthetic oligonucleotide
cccauugacuauuacuuuccaccccca

SEQ ID NO: 4048 - RNA, 27 nt, Artificial Sequence
  Description of Artificial Sequence: Synthetic oligonucleotide
gcaaggucuucuucaaaagagccgcca

SEQ ID NO: 4049 - RNA, 27 nt, Artificial Sequence
  Description of Artificial Sequence: Synthetic oligonucleotide
ugauugcacuauugauaaauuccgaca

SEQ ID NO: 4050 - RNA, 27 nt, Artificial Sequence
  Description of Artificial Sequence: Synthetic oligonucleotide
uccgaaggaaaaauuguccaucuugca

SEQ ID NO: 4051 - RNA, 27 nt, Artificial Sequence
  Description of Artificial Sequence: Synthetic oligonucleotide
aggaaaaauuguccaucuugucguccc

SEQ ID NO: 4052 - RNA, 27 nt, Artificial Sequence
  Description of Artificial Sequence: Synthetic oligonucleotide
gacagugucacacauugaaggcuauac

SEQ ID NO: 4053 - RNA, 27 nt, Artificial Sequence
  Description of Artificial Sequence: Synthetic oligonucleotide
auugaaggcuaugaaugucagcccaca

SEQ ID NO: 4054 - RNA, 27 nt, Artificial Sequence
  Description of Artificial Sequence: Synthetic oligonucleotide
agauggcugucauucaguacuccugac

SEQ ID NO: 4055 - RNA, 27 nt, Artificial Sequence
  Description of Artificial Sequence: Synthetic oligonucleotide
ucugguuuucaaugaguaccgcaugac

SEQ ID NO: 4056 - RNA, 27 nt, Artificial Sequence
  Description of Artificial Sequence: Synthetic oligonucleotide
aggaauuccugugcaugaaagcacuaa

SEQ ID NO: 4057 - RNA, 27 nt, Artificial Sequence
  Description of Artificial Sequence: Synthetic oligonucleotide
caaaaauucuuugaugaacuucgaaca

SEQ ID NO: 4058 - RNA, 27 nt, Artificial Sequence
  Description of Artificial Sequence: Synthetic oligonucleotide
cuuugaugaacuucgaaugaacuaccc

SEQ ID NO: 4059 - RNA, 27 nt, Artificial Sequence
  Description of Artificial Sequence: Synthetic oligonucleotide
ugaugaacuucgaaugaacuacauccc

SEQ ID NO: 4060 - RNA, 27 nt, Artificial Sequence
  Description of Artificial Sequence: Synthetic oligonucleotide
cgaaugaacuacaucaaggaacucgcc

SEQ ID NO: 4061 - RNA, 27 nt, Artificial Sequence
  Description of Artificial Sequence: Synthetic oligonucleotide
aaugaacuacaucaaggaacucgauaa

SEQ ID NO: 4062 - RNA, 27 nt, Artificial Sequence
  Description of Artificial Sequence: Synthetic oligonucleotide
gcaaaagaaaaaaucccacauccugac

SEQ ID NO: 4063 - RNA, 27 nt, Artificial Sequence
  Description of Artificial Sequence: Synthetic oligonucleotide
aagaaaaaaucccacauccugcucaca

SEQ ID NO: 4064 - RNA, 27 nt, Artificial Sequence
  Description of Artificial Sequence: Synthetic oligonucleotide
cuuuugaccugcuaaucaagucacaac

SEQ ID NO: 4065 - RNA, 27 nt, Artificial Sequence
  Description of Artificial Sequence: Synthetic oligonucleotide
gccuguuauaacucugcacuacuccca

SEQ ID NO: 4066 - RNA, 27 nt, Artificial Sequence
  Description of Artificial Sequence: Synthetic oligonucleotide
cuguuauaacucugcacuacuccucca

SEQ ID NO: 4067 - RNA, 27 nt, Artificial Sequence
  Description of Artificial Sequence: Synthetic oligonucleotide
ggaauuuccucuauugauguacaguac

SEQ ID NO: 4068 - RNA, 27 nt, Artificial Sequence
  Description of Artificial Sequence: Synthetic oligonucleotide
cucuauugauguacagucugucaugcc

SEQ ID NO: 4069 - RNA, 27 nt, Artificial Sequence
  Description of Artificial Sequence: Synthetic oligonucleotide
ucaugaacauguuccugaauucuaucc

SEQ ID NO: 4070 - RNA, 27 nt, Artificial Sequence
  Description of Artificial Sequence: Synthetic oligonucleotide
uccugaauucuauuugcugggcuuucc

SEQ ID NO: 4071 - RNA, 27 nt, Artificial Sequence
  Description of Artificial Sequence: Synthetic oligonucleotide
gcuuuuuuuuucucuuucucuccuuca

SEQ ID NO: 4072 - RNA, 27 nt, Artificial Sequence
  Description of Artificial Sequence: Synthetic oligonucleotide
uuuuuucucuuucucuccuuucuuucc

SEQ ID NO: 4073 - RNA, 27 nt, Artificial Sequence
  Description of Artificial Sequence: Synthetic oligonucleotide
cucuuucucuccuuucuuuuucuuccc

SEQ ID NO: 4074 - RNA, 27 nt, Artificial Sequence
  Description of Artificial Sequence: Synthetic oligonucleotide
ccauggcaccuucagacuuugcuucaa

SEQ ID NO: 4075 - RNA, 27 nt, Artificial Sequence
  Description of Artificial Sequence: Synthetic oligonucleotide
uguuuugaaugguguuguaugccuucc

SEQ ID NO: 4076 - RNA, 27 nt, Artificial Sequence
  Description of Artificial Sequence: Synthetic oligonucleotide
ugguguuguaugccuuuaaaucuguac

SEQ ID NO: 4077 - RNA, 27 nt, Artificial Sequence
  Description of Artificial Sequence: Synthetic oligonucleotide
cuuuaaaucugugaugauccucauaca

SEQ ID NO: 4078 - RNA, 27 nt, Artificial Sequence
  Description of Artificial Sequence: Synthetic oligonucleotide
ucugugaugauccucauauggcccaac

SEQ ID NO: 4079 - RNA, 27 nt, Artificial Sequence
  Description of Artificial Sequence: Synthetic oligonucleotide
aaguugugcuuguuuacagcacuacca

SEQ ID NO: 4080 - RNA, 27 nt, Artificial Sequence
  Description of Artificial Sequence: Synthetic oligonucleotide
acguuuacuuaucuuaugccacgggcc

SEQ ID NO: 4081 - RNA, 27 nt, Artificial Sequence
  Description of Artificial Sequence: Synthetic oligonucleotide
aguuuagagagcuaagauuaucuggaa

SEQ ID NO: 4082 - RNA, 27 nt, Artificial Sequence
  Description of Artificial Sequence: Synthetic oligonucleotide
gcuaagauuaucuggggaaaucaaaca

SEQ ID NO: 4083 - RNA, 27 nt, Artificial Sequence
  Description of Artificial Sequence: Synthetic oligonucleotide
cuggggaaaucaaaacaaaaacaagac

SEQ ID NO: 4084 - RNA, 27 nt, Artificial Sequence
  Description of Artificial Sequence: Synthetic oligonucleotide
gagccagcuugcugggagagcgggaaa

SEQ ID NO: 4085 - RNA, 27 nt, Artificial Sequence
  Description of Artificial Sequence: Synthetic oligonucleotide
cggcuccagcgacagccaacgccuccc

SEQ ID NO: 4086 - RNA, 27 nt, Artificial Sequence
  Description of Artificial Sequence: Synthetic oligonucleotide
cagccaacgccucuugcagcgcggcaa

SEQ ID NO: 4087 - RNA, 27 nt, Artificial Sequence
  Description of Artificial Sequence: Synthetic oligonucleotide
gccucuugcagcgcggcggcuucgaca

SEQ ID NO: 4088 - RNA, 27 nt, Artificial Sequence
  Description of Artificial Sequence: Synthetic oligonucleotide
ugcagcgcggcggcuucgaagccgcaa

SEQ ID NO: 4089 - RNA, 27 nt, Artificial Sequence
  Description of Artificial Sequence: Synthetic oligonucleotide
cgaagccgccgcccggagcugcccucc

SEQ ID NO: 4090 - RNA, 27 nt, Artificial Sequence
  Description of Artificial Sequence: Synthetic oligonucleotide
cgccgcccggagcugcccuuuccuccc

SEQ ID NO: 4091 - RNA, 27 nt, Artificial Sequence
  Description of Artificial Sequence: Synthetic oligonucleotide
ugaaguuuuuaaaagcugcuaaagaac

SEQ ID NO: 4092 - RNA, 27 nt, Artificial Sequence
  Description of Artificial Sequence: Synthetic oligonucleotide
ccgucuucucucccgcagcugccucca

SEQ ID NO: 4093 - RNA, 27 nt, Artificial Sequence
  Description of Artificial Sequence: Synthetic oligonucleotide
ccgcagcugccucagucggcuacucca

SEQ ID NO: 4094 - RNA, 27 nt, Artificial Sequence
  Description of Artificial Sequence: Synthetic oligonucleotide
uuuggcugcgagcgggcgagcuagcca

SEQ ID NO: 4095 - RNA, 27 nt, Artificial Sequence
  Description of Artificial Sequence: Synthetic oligonucleotide
cgggcgagcuagcugcacauugcaaca

SEQ ID NO: 4096 - RNA, 27 nt, Artificial Sequence
  Description of Artificial Sequence: Synthetic oligonucleotide
ucucucuccaccuccuccugccuucaa

SEQ ID NO: 4097 - RNA, 27 nt, Artificial Sequence
  Description of Artificial Sequence: Synthetic oligonucleotide
ccagagaucaaaagaugaaaaggcaac

SEQ ID NO: 4098 - RNA, 27 nt, Artificial Sequence
  Description of Artificial Sequence: Synthetic oligonucleotide
caguagccaaaaaacaaaacaaacacc

SEQ ID NO: 4099 - RNA, 27 nt, Artificial Sequence
  Description of Artificial Sequence: Synthetic oligonucleotide
ccaaaaaacaaaacaaacaaaaacacc

SEQ ID NO: 4100 - RNA, 27 nt, Artificial Sequence
  Description of Artificial Sequence: Synthetic oligonucleotide
acaaaacaaacaaaaacaaaaaagcaa

SEQ ID NO: 4101 - RNA, 27 nt, Artificial Sequence
  Description of Artificial Sequence: Synthetic oligonucleotide
acaaaaaagccgaaauaaaagaaaaca

SEQ ID NO: 4102 - RNA, 27 nt, Artificial Sequence
  Description of Artificial Sequence: Synthetic oligonucleotide
gccgaaauaaaagaaaaagauaauaca

SEQ ID NO: 4103 - RNA, 27 nt, Artificial Sequence
  Description of Artificial Sequence: Synthetic oligonucleotide
aagaaaaagauaauaacucaguucucc

SEQ ID NO: 4104 - RNA, 27 nt, Artificial Sequence
  Description of Artificial Sequence: Synthetic oligonucleotide
aaagauaauaacucaguucuuauuuaa

SEQ ID NO: 4105 - RNA, 27 nt, Artificial Sequence
  Description of Artificial Sequence: Synthetic oligonucleotide
gauaauaacucaguucuuauuugcaaa

SEQ ID NO: 4106 - RNA, 27 nt, Artificial Sequence
  Description of Artificial Sequence: Synthetic oligonucleotide
uggaggauuuuguuuuuuucuuuuaca

SEQ ID NO: 4107 - RNA, 27 nt, Artificial Sequence
  Description of Artificial Sequence: Synthetic oligonucleotide
gauuuuguuuuuuucuuuuaagaucca

SEQ ID NO: 4108 - RNA, 27 nt, Artificial Sequence
  Description of Artificial Sequence: Synthetic oligonucleotide
guuuuuuucuuuuaagaucugggcaca

SEQ ID NO: 4109 - RNA, 27 nt, Artificial Sequence
  Description of Artificial Sequence: Synthetic oligonucleotide
gggcaucuuuugaaucuacccuucaca

SEQ ID NO: 4110 - RNA, 27 nt, Artificial Sequence
  Description of Artificial Sequence: Synthetic oligonucleotide
cagagcgcuuuuugcgugguugcucaa

SEQ ID NO: 4111 - RNA, 27 nt, Artificial Sequence
  Description of Artificial Sequence: Synthetic oligonucleotide
cgcuuuuugcgugguugcucccgcaca

SEQ ID NO: 4112 - RNA, 27 nt, Artificial Sequence
  Description of Artificial Sequence: Synthetic oligonucleotide
aaguuuccuucucuggagcuucccgac

SEQ ID NO: 4113 - RNA, 27 nt, Artificial Sequence
  Description of Artificial Sequence: Synthetic oligonucleotide
agcuucccgcaggugggcagcuagcca

SEQ ID NO: 4114 - RNA, 27 nt, Artificial Sequence
  Description of Artificial Sequence: Synthetic oligonucleotide
gugggcagcuagcugcagcgacuacaa

SEQ ID NO: 4115 - RNA, 27 nt, Artificial Sequence
  Description of Artificial Sequence: Synthetic oligonucleotide
aagugcaguuagggcugggaaggguac

SEQ ID NO: 4116 - RNA, 27 nt, Artificial Sequence
  Description of Artificial Sequence: Synthetic oligonucleotide
agugcaguuagggcugggaaggguccc

SEQ ID NO: 4117 - RNA, 27 nt, Artificial Sequence
  Description of Artificial Sequence: Synthetic oligonucleotide
gugcaguuagggcugggaagggucuca

SEQ ID NO: 4118 - RNA, 27 nt, Artificial Sequence
  Description of Artificial Sequence: Synthetic oligonucleotide
ugcaguuagggcugggaagggucuaaa

SEQ ID NO: 4119 - RNA, 27 nt, Artificial Sequence
  Description of Artificial Sequence: Synthetic oligonucleotide
gcaguuagggcugggaagggucuacaa

SEQ ID NO: 4120 - RNA, 27 nt, Artificial Sequence
  Description of Artificial Sequence: Synthetic oligonucleotide
caguuagggcugggaagggucuaccac

SEQ ID NO: 4121 - RNA, 27 nt, Artificial Sequence
  Description of Artificial Sequence: Synthetic oligonucleotide
aguuagggcugggaagggucuacccca

SEQ ID NO: 4122 - RNA, 27 nt, Artificial Sequence
  Description of Artificial Sequence: Synthetic oligonucleotide
guuagggcugggaagggucuacccuaa

SEQ ID NO: 4123 - RNA, 27 nt, Artificial Sequence
  Description of Artificial Sequence: Synthetic oligonucleotide
uuagggcugggaagggucuacccucaa

SEQ ID NO: 4124 - RNA, 27 nt, Artificial Sequence
  Description of Artificial Sequence: Synthetic oligonucleotide
uagggcugggaagggucuacccucgaa

SEQ ID NO: 4125 - RNA, 27 nt, Artificial Sequence
  Description of Artificial Sequence: Synthetic oligonucleotide
agggcugggaagggucuacccucggaa

SEQ ID NO: 4126 - RNA, 27 nt, Artificial Sequence
  Description of Artificial Sequence: Synthetic oligonucleotide
cuuuccagaaucuguuccagagcguaa

SEQ ID NO: 4127 - RNA, 27 nt, Artificial Sequence
  Description of Artificial Sequence: Synthetic oligonucleotide
uuuccagaaucuguuccagagcgugaa

SEQ ID NO: 4128 - RNA, 27 nt, Artificial Sequence
  Description of Artificial Sequence: Synthetic oligonucleotide
uuccagaaucuguuccagagcgugcaa

SEQ ID NO: 4129 - RNA, 27 nt, Artificial Sequence
  Description of Artificial Sequence: Synthetic oligonucleotide
uccagaaucuguuccagagcgugcgaa

SEQ ID NO: 4130 - RNA, 27 nt, Artificial Sequence
  Description of Artificial Sequence: Synthetic oligonucleotide
ccagaaucuguuccagagcgugcgcac

SEQ ID NO: 4131 - RNA, 27 nt, Artificial Sequence
  Description of Artificial Sequence: Synthetic oligonucleotide
cagaaucuguuccagagcgugcgcgcc

SEQ ID NO: 4132 - RNA, 27 nt, Artificial Sequence
  Description of Artificial Sequence: Synthetic oligonucleotide
agaaucuguuccagagcgugcgcgaca

SEQ ID NO: 4133 - RNA, 27 nt, Artificial Sequence
  Description of Artificial Sequence: Synthetic oligonucleotide
gaaucuguuccagagcgugcgcgaaac

SEQ ID NO: 4134 - RNA, 27 nt, Artificial Sequence
  Description of Artificial Sequence: Synthetic oligonucleotide
aaucuguuccagagcgugcgcgaagca

SEQ ID NO: 4135 - RNA, 27 nt, Artificial Sequence
  Description of Artificial Sequence: Synthetic oligonucleotide
aucuguuccagagcgugcgcgaaguac

SEQ ID NO: 4136 - RNA, 27 nt, Artificial Sequence
  Description of Artificial Sequence: Synthetic oligonucleotide
ucuguuccagagcgugcgcgaagugcc

SEQ ID NO: 4137 - RNA, 27 nt, Artificial Sequence
  Description of Artificial Sequence: Synthetic oligonucleotide
cuguuccagagcgugcgcgaagugaca

SEQ ID NO: 4138 - RNA, 27 nt, Artificial Sequence
  Description of Artificial Sequence: Synthetic oligonucleotide
uguuccagagcgugcgcgaagugauaa

SEQ ID NO: 4139 - RNA, 27 nt, Artificial Sequence
  Description of Artificial Sequence: Synthetic oligonucleotide
ggcgccaguuugcugcugcugcagcca

SEQ ID NO: 4140 - RNA, 27 nt, Artificial Sequence
  Description of Artificial Sequence: Synthetic oligonucleotide
uugcugcugcugcagcagcagcagcca

SEQ ID NO: 4141 - RNA, 27 nt, Artificial Sequence
  Description of Artificial Sequence: Synthetic oligonucleotide
gcgucccagagccuggagccgccguaa

SEQ ID NO: 4142 - RNA, 27 nt, Artificial Sequence
  Description of Artificial Sequence: Synthetic oligonucleotide
ggcugccgcagcagcugccagcaccca

SEQ ID NO: 4143 - RNA, 27 nt, Artificial Sequence
  Description of Artificial Sequence: Synthetic oligonucleotide
cgcagcagcugccagcaccuccggaaa

SEQ ID NO: 4144 - RNA, 27 nt, Artificial Sequence
  Description of Artificial Sequence: Synthetic oligonucleotide
cccauccacguugucccugcugggcaa

SEQ ID NO: 4145 - RNA, 27 nt, Artificial Sequence
  Description of Artificial Sequence: Synthetic oligonucleotide
ccggcuuaagcagcugcuccgcugaaa

SEQ ID NO: 4146 - RNA, 27 nt, Artificial Sequence
  Description of Artificial Sequence: Synthetic oligonucleotide
cggcuuaagcagcugcuccgcugacac

SEQ ID NO: 4147 - RNA, 27 nt, Artificial Sequence
  Description of Artificial Sequence: Synthetic oligonucleotide
uaagcagcugcuccgcugaccuuaaca

SEQ ID NO: 4148 - RNA, 27 nt, Artificial Sequence
  Description of Artificial Sequence: Synthetic oligonucleotide
augcaacuccuucagcaacagcagcca

SEQ ID NO: 4149 - RNA, 27 nt, Artificial Sequence
  Description of Artificial Sequence: Synthetic oligonucleotide
accauuucugacaacgccaaggaguca

SEQ ID NO: 4150 - RNA, 27 nt, Artificial Sequence
  Description of Artificial Sequence: Synthetic oligonucleotide
ccacuuuugggaguuccacccgcugca

SEQ ID NO: 4151 - RNA, 27 nt, Artificial Sequence
  Description of Artificial Sequence: Synthetic oligonucleotide
caggcaagagcacugaagauacugcca

SEQ ID NO: 4152 - RNA, 27 nt, Artificial Sequence
  Description of Artificial Sequence: Synthetic oligonucleotide
cuggcagcgcugcagcagggagcucaa

SEQ ID NO: 4153 - RNA, 27 nt, Artificial Sequence
  Description of Artificial Sequence: Synthetic oligonucleotide
agucgcgacuacuacaacuuuccacca

SEQ ID NO: 4154 - RNA, 27 nt, Artificial Sequence
  Description of Artificial Sequence: Synthetic oligonucleotide
gucgcgacuacuacaacuuuccacuaa

SEQ ID NO: 4155 - RNA, 27 nt, Artificial Sequence
  Description of Artificial Sequence: Synthetic oligonucleotide
ucgcgacuacuacaacuuuccacugaa

SEQ ID NO: 4156 - RNA, 27 nt, Artificial Sequence
  Description of Artificial Sequence: Synthetic oligonucleotide
gcucgcaucaagcuggagaacccgcca

SEQ ID NO: 4157 - RNA, 27 nt, Artificial Sequence
  Description of Artificial Sequence: Synthetic oligonucleotide
gcuggacuacggcagcgccugggcgaa

SEQ ID NO: 4158 - RNA, 27 nt, Artificial Sequence
  Description of Artificial Sequence: Synthetic oligonucleotide
cuggacuacggcagcgccugggcggac

SEQ ID NO: 4159 - RNA, 27 nt, Artificial Sequence
  Description of Artificial Sequence: Synthetic oligonucleotide
uggacuacggcagcgccugggcggcca

SEQ ID NO: 4160 - RNA, 27 nt, Artificial Sequence
  Description of Artificial Sequence: Synthetic oligonucleotide
ggacuacggcagcgccugggcggcuaa

SEQ ID NO: 4161 - RNA, 27 nt, Artificial Sequence
  Description of Artificial Sequence: Synthetic oligonucleotide
uggcgcgggugcagcgggacccgguca

SEQ ID NO: 4162 - RNA, 27 nt, Artificial Sequence
  Description of Artificial Sequence: Synthetic oligonucleotide
ggcuggcgggccaggaaagcgacuuac

SEQ ID NO: 4163 - RNA, 27 nt, Artificial Sequence
  Description of Artificial Sequence: Synthetic oligonucleotide
guacccuggcggcauggugagcagaac

SEQ ID NO: 4164 - RNA, 27 nt, Artificial Sequence
  Description of Artificial Sequence: Synthetic oligonucleotide
uggauggauagcuacuccggaccuuca

SEQ ID NO: 4165 - RNA, 27 nt, Artificial Sequence
  Description of Artificial Sequence: Synthetic oligonucleotide
cccagaagaccugccugaucuguggca

SEQ ID NO: 4166 - RNA, 27 nt, Artificial Sequence
  Description of Artificial Sequence: Synthetic oligonucleotide
ccagaagaccugccugaucuguggaac

SEQ ID NO: 4167 - RNA, 27 nt, Artificial Sequence
  Description of Artificial Sequence: Synthetic oligonucleotide
cagaagaccugccugaucuguggagcc

SEQ ID NO: 4168 - RNA, 27 nt, Artificial Sequence
  Description of Artificial Sequence: Synthetic oligonucleotide
agaagaccugccugaucuguggagaca

SEQ ID NO: 4169 - RNA, 27 nt, Artificial Sequence
  Description of Artificial Sequence: Synthetic oligonucleotide
gaagaccugccugaucuguggagauac

SEQ ID NO: 4170 - RNA, 27 nt, Artificial Sequence
  Description of Artificial Sequence: Synthetic oligonucleotide
aagaccugccugaucuguggagaugcc

SEQ ID NO: 4171 - RNA, 27 nt, Artificial Sequence
  Description of Artificial Sequence: Synthetic oligonucleotide
agaccugccugaucuguggagaugaca

SEQ ID NO: 4172 - RNA, 27 nt, Artificial Sequence
  Description of Artificial Sequence: Synthetic oligonucleotide
gaccugccugaucuguggagaugaaaa

SEQ ID NO: 4173 - RNA, 27 nt, Artificial Sequence
  Description of Artificial Sequence: Synthetic oligonucleotide
accugccugaucuguggagaugaagac

SEQ ID NO: 4174 - RNA, 27 nt, Artificial Sequence
  Description of Artificial Sequence: Synthetic oligonucleotide
ccugccugaucuguggagaugaagccc

SEQ ID NO: 4175 - RNA, 27 nt, Artificial Sequence
  Description of Artificial Sequence: Synthetic oligonucleotide
cugccugaucuguggagaugaagcuca

SEQ ID NO: 4176 - RNA, 27 nt, Artificial Sequence
  Description of Artificial Sequence: Synthetic oligonucleotide
ugccugaucuguggagaugaagcuuac

SEQ ID NO: 4177 - RNA, 27 nt, Artificial Sequence
  Description of Artificial Sequence: Synthetic oligonucleotide
gccugaucuguggagaugaagcuucca

SEQ ID NO: 4178 - RNA, 27 nt, Artificial Sequence
  Description of Artificial Sequence: Synthetic oligonucleotide
ccugaucuguggagaugaagcuucuaa

SEQ ID NO: 4179 - RNA, 27 nt, Artificial Sequence
  Description of Artificial Sequence: Synthetic oligonucleotide
cugaucuguggagaugaagcuucugaa

SEQ ID NO: 4180 - RNA, 27 nt, Artificial Sequence
  Description of Artificial Sequence: Synthetic oligonucleotide
ugaucuguggagaugaagcuucuggac

SEQ ID NO: 4181 - RNA, 27 nt, Artificial Sequence
  Description of Artificial Sequence: Synthetic oligonucleotide
gaucuguggagaugaagcuucugggca

SEQ ID NO: 4182 - RNA, 27 nt, Artificial Sequence
  Description of Artificial Sequence: Synthetic oligonucleotide
aucuguggagaugaagcuucuggguac

SEQ ID NO: 4183 - RNA, 27 nt, Artificial Sequence
  Description of Artificial Sequence: Synthetic oligonucleotide
ucuguggagaugaagcuucugggugca

SEQ ID NO: 4184 - RNA, 27 nt, Artificial Sequence
  Description of Artificial Sequence: Synthetic oligonucleotide
cuguggagaugaagcuucuggguguac

SEQ ID NO: 4185 - RNA, 27 nt, Artificial Sequence
  Description of Artificial Sequence: Synthetic oligonucleotide
gcuucugggugucacuauggagcucca

SEQ ID NO: 4186 - RNA, 27 nt, Artificial Sequence
  Description of Artificial Sequence: Synthetic oligonucleotide
uggagcucucacauguggaagcugccc

SEQ ID NO: 4187 - RNA, 27 nt, Artificial Sequence
  Description of Artificial Sequence: Synthetic oligonucleotide
gaagcugcaaggucuucuucaaaagca

SEQ ID NO: 4188 - RNA, 27 nt, Artificial Sequence
  Description of Artificial Sequence: Synthetic oligonucleotide
aagcugcaaggucuucuucaaaagaaa

SEQ ID NO: 4189 - RNA, 27 nt, Artificial Sequence
  Description of Artificial Sequence: Synthetic oligonucleotide
agcugcaaggucuucuucaaaagagaa

SEQ ID NO: 4190 - RNA, 27 nt, Artificial Sequence
  Description of Artificial Sequence: Synthetic oligonucleotide
gcugcaaggucuucuucaaaagagcaa

SEQ ID NO: 4191 - RNA, 27 nt, Artificial Sequence
  Description of Artificial Sequence: Synthetic oligonucleotide
cugcaaggucuucuucaaaagagccaa

SEQ ID NO: 4192 - RNA, 27 nt, Artificial Sequence
  Description of Artificial Sequence: Synthetic oligonucleotide
ugcaaggucuucuucaaaagagccgac

SEQ ID NO: 4193 - RNA, 27 nt, Artificial Sequence
  Description of Artificial Sequence: Synthetic oligonucleotide
gcaaggucuucuucaaaagagccgcca

SEQ ID NO: 4194 - RNA, 27 nt, Artificial Sequence
  Description of Artificial Sequence: Synthetic oligonucleotide
caaggucuucuucaaaagagccgcuac

SEQ ID NO: 4195 - RNA, 27 nt, Artificial Sequence
  Description of Artificial Sequence: Synthetic oligonucleotide
aaggucuucuucaaaagagccgcugcc

SEQ ID NO: 4196 - RNA, 27 nt, Artificial Sequence
  Description of Artificial Sequence: Synthetic oligonucleotide
aggucuucuucaaaagagccgcugaca

SEQ ID NO: 4197 - RNA, 27 nt, Artificial Sequence
  Description of Artificial Sequence: Synthetic oligonucleotide
ggucuucuucaaaagagccgcugaaaa

SEQ ID NO: 4198 - RNA, 27 nt, Artificial Sequence
  Description of Artificial Sequence: Synthetic oligonucleotide
gucuucuucaaaagagccgcugaagaa

SEQ ID NO: 4199 - RNA, 27 nt, Artificial Sequence
  Description of Artificial Sequence: Synthetic oligonucleotide
ucuucuucaaaagagccgcugaaggac

SEQ ID NO: 4200 - RNA, 27 nt, Artificial Sequence
  Description of Artificial Sequence: Synthetic oligonucleotide
cuucuucaaaagagccgcugaagggcc

SEQ ID NO: 4201 - RNA, 27 nt, Artificial Sequence
  Description of Artificial Sequence: Synthetic oligonucleotide
uucuucaaaagagccgcugaagggacc

SEQ ID NO: 4202 - RNA, 27 nt, Artificial Sequence
  Description of Artificial Sequence: Synthetic oligonucleotide
ucuucaaaagagccgcugaagggaaca

SEQ ID NO: 4203 - RNA, 27 nt, Artificial Sequence
  Description of Artificial Sequence: Synthetic oligonucleotide
cuucaaaagagccgcugaagggaaaac

SEQ ID NO: 4204 - RNA, 27 nt, Artificial Sequence
  Description of Artificial Sequence: Synthetic oligonucleotide
uucaaaagagccgcugaagggaaacca

SEQ ID NO: 4205 - RNA, 27 nt, Artificial Sequence
  Description of Artificial Sequence: Synthetic oligonucleotide
ucaaaagagccgcugaagggaaacaac

SEQ ID NO: 4206 - RNA, 27 nt, Artificial Sequence
  Description of Artificial Sequence: Synthetic oligonucleotide
caaaagagccgcugaagggaaacagcc

SEQ ID NO: 4207 - RNA, 27 nt, Artificial Sequence
  Description of Artificial Sequence: Synthetic oligonucleotide
aaaagagccgcugaagggaaacagaca

SEQ ID NO: 4208 - RNA, 27 nt, Artificial Sequence
  Description of Artificial Sequence: Synthetic oligonucleotide
aaagagccgcugaagggaaacagaaac

SEQ ID NO: 4209 - RNA, 27 nt, Artificial Sequence
  Description of Artificial Sequence: Synthetic oligonucleotide
aagagccgcugaagggaaacagaagcc

SEQ ID NO: 4210 - RNA, 27 nt, Artificial Sequence
  Description of Artificial Sequence: Synthetic oligonucleotide
agagccgcugaagggaaacagaaguca

SEQ ID NO: 4211 - RNA, 27 nt, Artificial Sequence
  Description of Artificial Sequence: Synthetic oligonucleotide
gagccgcugaagggaaacagaaguaaa

SEQ ID NO: 4212 - RNA, 27 nt, Artificial Sequence
  Description of Artificial Sequence: Synthetic oligonucleotide
agccgcugaagggaaacagaaguacac

SEQ ID NO: 4213 - RNA, 27 nt, Artificial Sequence
  Description of Artificial Sequence: Synthetic oligonucleotide
ccgcugaagggaaacagaaguaccuac

SEQ ID NO: 4214 - RNA, 27 nt, Artificial Sequence
  Description of Artificial Sequence: Synthetic oligonucleotide
cgcugaagggaaacagaaguaccugca

SEQ ID NO: 4215 - RNA, 27 nt, Artificial Sequence
  Description of Artificial Sequence: Synthetic oligonucleotide
ccugugcgccagcagaaaugauugcca

SEQ ID NO: 4216 - RNA, 27 nt, Artificial Sequence
  Description of Artificial Sequence: Synthetic oligonucleotide
gcagaaaugauugcacuauugauaacc

SEQ ID NO: 4217 - RNA, 27 nt, Artificial Sequence
  Description of Artificial Sequence: Synthetic oligonucleotide
aaugauugcacuauugauaaauuccac

SEQ ID NO: 4218 - RNA, 27 nt, Artificial Sequence
  Description of Artificial Sequence: Synthetic oligonucleotide
cacuauugauaaauuccgaaggaaacc

SEQ ID NO: 4219 - RNA, 27 nt, Artificial Sequence
  Description of Artificial Sequence: Synthetic oligonucleotide
uucggaaauguuaugaagcagggauac

SEQ ID NO: 4220 - RNA, 27 nt, Artificial Sequence
  Description of Artificial Sequence: Synthetic oligonucleotide
ucggaaauguuaugaagcagggaugca

SEQ ID NO: 4221 - RNA, 27 nt, Artificial Sequence
  Description of Artificial Sequence: Synthetic oligonucleotide
cggaaauguuaugaagcagggaugaac

SEQ ID NO: 4222 - RNA, 27 nt, Artificial Sequence
  Description of Artificial Sequence: Synthetic oligonucleotide
ggaaauguuaugaagcagggaugacca

SEQ ID NO: 4223 - RNA, 27 nt, Artificial Sequence
  Description of Artificial Sequence: Synthetic oligonucleotide
gaaauguuaugaagcagggaugacuac

SEQ ID NO: 4224 - RNA, 27 nt, Artificial Sequence
  Description of Artificial Sequence: Synthetic oligonucleotide
aaauguuaugaagcagggaugacucca

SEQ ID NO: 4225 - RNA, 27 nt, Artificial Sequence
  Description of Artificial Sequence: Synthetic oligonucleotide
aauguuaugaagcagggaugacucuaa

SEQ ID NO: 4226 - RNA, 27 nt, Artificial Sequence
  Description of Artificial Sequence: Synthetic oligonucleotide
auguuaugaagcagggaugacucugaa

SEQ ID NO: 4227 - RNA, 27 nt, Artificial Sequence
  Description of Artificial Sequence: Synthetic oligonucleotide
uguuaugaagcagggaugacucuggac

SEQ ID NO: 4228 - RNA, 27 nt, Artificial Sequence
  Description of Artificial Sequence: Synthetic oligonucleotide
guuaugaagcagggaugacucugggca

SEQ ID NO: 4229 - RNA, 27 nt, Artificial Sequence
  Description of Artificial Sequence: Synthetic oligonucleotide
uuaugaagcagggaugacucugggaaa

SEQ ID NO: 4230 - RNA, 27 nt, Artificial Sequence
  Description of Artificial Sequence: Synthetic oligonucleotide
uaugaagcagggaugacucugggagaa

SEQ ID NO: 4231 - RNA, 27 nt, Artificial Sequence
  Description of Artificial Sequence: Synthetic oligonucleotide
augaagcagggaugacucugggagcaa

SEQ ID NO: 4232 - RNA, 27 nt, Artificial Sequence
  Description of Artificial Sequence: Synthetic oligonucleotide
ugaagcagggaugacucugggagccaa

SEQ ID NO: 4233 - RNA, 27 nt, Artificial Sequence
  Description of Artificial Sequence: Synthetic oligonucleotide
gaagcagggaugacucugggagcccaa

SEQ ID NO: 4234 - RNA, 27 nt, Artificial Sequence
  Description of Artificial Sequence: Synthetic oligonucleotide
aagcagggaugacucugggagcccgac

SEQ ID NO: 4235 - RNA, 27 nt, Artificial Sequence
  Description of Artificial Sequence: Synthetic oligonucleotide
agcagggaugacucugggagcccggcc

SEQ ID NO: 4236 - RNA, 27 nt, Artificial Sequence
  Description of Artificial Sequence: Synthetic oligonucleotide
cugaagaaacuugguaaucugaaaccc

SEQ ID NO: 4237 - RNA, 27 nt, Artificial Sequence
  Description of Artificial Sequence: Synthetic oligonucleotide
ugaaacuacaggaggaaggagaggccc

SEQ ID NO: 4238 - RNA, 27 nt, Artificial Sequence
  Description of Artificial Sequence: Synthetic oligonucleotide
gaaacuacaggaggaaggagaggcuca

SEQ ID NO: 4239 - RNA, 27 nt, Artificial Sequence
  Description of Artificial Sequence: Synthetic oligonucleotide
cacauugaaggcuaugaaugucagcaa

SEQ ID NO: 4240 - RNA, 27 nt, Artificial Sequence
  Description of Artificial Sequence: Synthetic oligonucleotide
acauugaaggcuaugaaugucagccac

SEQ ID NO: 4241 - RNA, 27 nt, Artificial Sequence
  Description of Artificial Sequence: Synthetic oligonucleotide
cauugaaggcuaugaaugucagccccc

SEQ ID NO: 4242 - RNA, 27 nt, Artificial Sequence
  Description of Artificial Sequence: Synthetic oligonucleotide
auugaaggcuaugaaugucagcccaca

SEQ ID NO: 4243 - RNA, 27 nt, Artificial Sequence
  Description of Artificial Sequence: Synthetic oligonucleotide
uugaaggcuaugaaugucagcccauac

SEQ ID NO: 4244 - RNA, 27 nt, Artificial Sequence
  Description of Artificial Sequence: Synthetic oligonucleotide
ugaaggcuaugaaugucagcccauccc

SEQ ID NO: 4245 - RNA, 27 nt, Artificial Sequence
  Description of Artificial Sequence: Synthetic oligonucleotide
auguccuggaagccauugagccaggca

SEQ ID NO: 4246 - RNA, 27 nt, Artificial Sequence
  Description of Artificial Sequence: Synthetic oligonucleotide
uguccuggaagccauugagccagguac

SEQ ID NO: 4247 - RNA, 27 nt, Artificial Sequence
  Description of Artificial Sequence: Synthetic oligonucleotide
guccuggaagccauugagccaggugcc

SEQ ID NO: 4248 - RNA, 27 nt, Artificial Sequence
  Description of Artificial Sequence: Synthetic oligonucleotide
uccuggaagccauugagccagguguca

SEQ ID NO: 4249 - RNA, 27 nt, Artificial Sequence
  Description of Artificial Sequence: Synthetic oligonucleotide
ccuggaagccauugagccagguguaac

SEQ ID NO: 4250 - RNA, 27 nt, Artificial Sequence
  Description of Artificial Sequence: Synthetic oligonucleotide
accagcccgacuccuuugcagccuuaa

SEQ ID NO: 4251 - RNA, 27 nt, Artificial Sequence
  Description of Artificial Sequence: Synthetic oligonucleotide
ccgacuccuuugcagccuugcucuccc

SEQ ID NO: 4252 - RNA, 27 nt, Artificial Sequence
  Description of Artificial Sequence: Synthetic oligonucleotide
ugcagccuugcucucuagccucaauac

SEQ ID NO: 4253 - RNA, 27 nt, Artificial Sequence
  Description of Artificial Sequence: Synthetic oligonucleotide
acguggucaagugggccaaggccuuaa

SEQ ID NO: 4254 - RNA, 27 nt, Artificial Sequence
  Description of Artificial Sequence: Synthetic oligonucleotide
cguggucaagugggccaaggccuugaa

SEQ ID NO: 4255 - RNA, 27 nt, Artificial Sequence
  Description of Artificial Sequence: Synthetic oligonucleotide
guggucaagugggccaaggccuugcac

SEQ ID NO: 4256 - RNA, 27 nt, Artificial Sequence
  Description of Artificial Sequence: Synthetic oligonucleotide
uggucaagugggccaaggccuugccca

SEQ ID NO: 4257 - RNA, 27 nt, Artificial Sequence
  Description of Artificial Sequence: Synthetic oligonucleotide
ggucaagugggccaaggccuugccuaa

SEQ ID NO: 4258 - RNA, 27 nt, Artificial Sequence
  Description of Artificial Sequence: Synthetic oligonucleotide
gucaagugggccaaggccuugccugaa

SEQ ID NO: 4259 - RNA, 27 nt, Artificial Sequence
  Description of Artificial Sequence: Synthetic oligonucleotide
ucaagugggccaaggccuugccuggac

SEQ ID NO: 4260 - RNA, 27 nt, Artificial Sequence
  Description of Artificial Sequence: Synthetic oligonucleotide
caagugggccaaggccuugccuggccc

SEQ ID NO: 4261 - RNA, 27 nt, Artificial Sequence
  Description of Artificial Sequence: Synthetic oligonucleotide
aagugggccaaggccuugccuggcuca

SEQ ID NO: 4262 - RNA, 27 nt, Artificial Sequence
  Description of Artificial Sequence: Synthetic oligonucleotide
agugggccaaggccuugccuggcuuaa

SEQ ID NO: 4263 - RNA, 27 nt, Artificial Sequence
  Description of Artificial Sequence: Synthetic oligonucleotide
gugggccaaggccuugccuggcuucaa

SEQ ID NO: 4264 - RNA, 27 nt, Artificial Sequence
  Description of Artificial Sequence: Synthetic oligonucleotide
ugggccaaggccuugccuggcuuccaa

SEQ ID NO: 4265 - RNA, 27 nt, Artificial Sequence
  Description of Artificial Sequence: Synthetic oligonucleotide
gggccaaggccuugccuggcuuccgac

SEQ ID NO: 4266 - RNA, 27 nt, Artificial Sequence
  Description of Artificial Sequence: Synthetic oligonucleotide
ggccaaggccuugccuggcuuccgccc

SEQ ID NO: 4267 - RNA, 27 nt, Artificial Sequence
  Description of Artificial Sequence: Synthetic oligonucleotide
gccaaggccuugccuggcuuccgcaca

SEQ ID NO: 4268 - RNA, 27 nt, Artificial Sequence
  Description of Artificial Sequence: Synthetic oligonucleotide
ccaaggccuugccuggcuuccgcaaac

SEQ ID NO: 4269 - RNA, 27 nt, Artificial Sequence
  Description of Artificial Sequence: Synthetic oligonucleotide
caaggccuugccuggcuuccgcaaccc

SEQ ID NO: 4270 - RNA, 27 nt, Artificial Sequence
  Description of Artificial Sequence: Synthetic oligonucleotide
aaggccuugccuggcuuccgcaacucc

SEQ ID NO: 4271 - RNA, 27 nt, Artificial Sequence
  Description of Artificial Sequence: Synthetic oligonucleotide
aggccuugccuggcuuccgcaacuuca

SEQ ID NO: 4272 - RNA, 27 nt, Artificial Sequence
  Description of Artificial Sequence: Synthetic oligonucleotide
ggccuugccuggcuuccgcaacuuaac

SEQ ID NO: 4273 - RNA, 27 nt, Artificial Sequence
  Description of Artificial Sequence: Synthetic oligonucleotide
gccuugccuggcuuccgcaacuuacca

SEQ ID NO: 4274 - RNA, 27 nt, Artificial Sequence
  Description of Artificial Sequence: Synthetic oligonucleotide
ccuugccuggcuuccgcaacuuacaaa

SEQ ID NO: 4275 - RNA, 27 nt, Artificial Sequence
  Description of Artificial Sequence: Synthetic oligonucleotide
cuugccuggcuuccgcaacuuacacac

SEQ ID NO: 4276 - RNA, 27 nt, Artificial Sequence
  Description of Artificial Sequence: Synthetic oligonucleotide
ccaaugucaacuccaggaugcucuaac

SEQ ID NO: 4277 - RNA, 27 nt, Artificial Sequence
  Description of Artificial Sequence: Synthetic oligonucleotide
caaugucaacuccaggaugcucuaccc

SEQ ID NO: 4278 - RNA, 27 nt, Artificial Sequence
  Description of Artificial Sequence: Synthetic oligonucleotide
aaugucaacuccaggaugcucuacuca

SEQ ID NO: 4279 - RNA, 27 nt, Artificial Sequence
  Description of Artificial Sequence: Synthetic oligonucleotide
augucaacuccaggaugcucuacuuaa

SEQ ID NO: 4280 - RNA, 27 nt, Artificial Sequence
  Description of Artificial Sequence: Synthetic oligonucleotide
ugucaacuccaggaugcucuacuucaa

SEQ ID NO: 4281 - RNA, 27 nt, Artificial Sequence
  Description of Artificial Sequence: Synthetic oligonucleotide
gucaacuccaggaugcucuacuucgaa

SEQ ID NO: 4282 - RNA, 27 nt, Artificial Sequence
  Description of Artificial Sequence: Synthetic oligonucleotide
ucaacuccaggaugcucuacuucgcaa

SEQ ID NO: 4283 - RNA, 27 nt, Artificial Sequence
  Description of Artificial Sequence: Synthetic oligonucleotide
ucugguuuucaaugaguaccgcaugac

SEQ ID NO: 4284 - RNA, 27 nt, Artificial Sequence
  Description of Artificial Sequence: Synthetic oligonucleotide
cugguuuucaaugaguaccgcaugcca

SEQ ID NO: 4285 - RNA, 27 nt, Artificial Sequence
  Description of Artificial Sequence: Synthetic oligonucleotide
ugguuuucaaugaguaccgcaugcaac

SEQ ID NO: 4286 - RNA, 27 nt, Artificial Sequence
  Description of Artificial Sequence: Synthetic oligonucleotide
gguuuucaaugaguaccgcaugcaccc

SEQ ID NO: 4287 - RNA, 27 nt, Artificial Sequence
  Description of Artificial Sequence: Synthetic oligonucleotide
guuuucaaugaguaccgcaugcacaca

SEQ ID NO: 4288 - RNA, 27 nt, Artificial Sequence
  Description of Artificial Sequence: Synthetic oligonucleotide
uuuucaaugaguaccgcaugcacaaac

SEQ ID NO: 4289 - RNA, 27 nt, Artificial Sequence
  Description of Artificial Sequence: Synthetic oligonucleotide
uuucaaugaguaccgcaugcacaagca

SEQ ID NO: 4290 - RNA, 27 nt, Artificial Sequence
  Description of Artificial Sequence: Synthetic oligonucleotide
uucaaugaguaccgcaugcacaaguaa

SEQ ID NO: 4291 - RNA, 27 nt, Artificial Sequence
  Description of Artificial Sequence: Synthetic oligonucleotide
ucaaugaguaccgcaugcacaagucaa

SEQ ID NO: 4292 - RNA, 27 nt, Artificial Sequence
  Description of Artificial Sequence: Synthetic oligonucleotide
caaugaguaccgcaugcacaaguccaa

SEQ ID NO: 4293 - RNA, 27 nt, Artificial Sequence
  Description of Artificial Sequence: Synthetic oligonucleotide
aaugaguaccgcaugcacaagucccaa

SEQ ID NO: 4294 - RNA, 27 nt, Artificial Sequence
  Description of Artificial Sequence: Synthetic oligonucleotide
augaguaccgcaugcacaagucccgac

SEQ ID NO: 4295 - RNA, 27 nt, Artificial Sequence
  Description of Artificial Sequence: Synthetic oligonucleotide
ugaguaccgcaugcacaagucccggcc

SEQ ID NO: 4296 - RNA, 27 nt, Artificial Sequence
  Description of Artificial Sequence: Synthetic oligonucleotide
ucucucaagaguuuggauggcuccacc

SEQ ID NO: 4297 - RNA, 27 nt, Artificial Sequence
  Description of Artificial Sequence: Synthetic oligonucleotide
cucucaagaguuuggauggcuccaacc

SEQ ID NO: 4298 - RNA, 27 nt, Artificial Sequence
  Description of Artificial Sequence: Synthetic oligonucleotide
ucucaagaguuuggauggcuccaaaca

SEQ ID NO: 4299 - RNA, 27 nt, Artificial Sequence
  Description of Artificial Sequence: Synthetic oligonucleotide
cucaagaguuuggauggcuccaaauac

SEQ ID NO: 4300 - RNA, 27 nt, Artificial Sequence
  Description of Artificial Sequence: Synthetic oligonucleotide
ucaagaguuuggauggcuccaaaucca

SEQ ID NO: 4301 - RNA, 27 nt, Artificial Sequence
  Description of Artificial Sequence: Synthetic oligonucleotide
caagaguuuggauggcuccaaaucaaa

SEQ ID NO: 4302 - RNA, 27 nt, Artificial Sequence
  Description of Artificial Sequence: Synthetic oligonucleotide
aagaguuuggauggcuccaaaucacaa

SEQ ID NO: 4303 - RNA, 27 nt, Artificial Sequence
  Description of Artificial Sequence: Synthetic oligonucleotide
cccaggaauuccugugcaugaaagcca

SEQ ID NO: 4304 - RNA, 27 nt, Artificial Sequence
  Description of Artificial Sequence: Synthetic oligonucleotide
ccaggaauuccugugcaugaaagcaac

SEQ ID NO: 4305 - RNA, 27 nt, Artificial Sequence
  Description of Artificial Sequence: Synthetic oligonucleotide
caggaauuccugugcaugaaagcacca

SEQ ID NO: 4306 - RNA, 27 nt, Artificial Sequence
  Description of Artificial Sequence: Synthetic oligonucleotide
aggaauuccugugcaugaaagcacuaa

SEQ ID NO: 4307 - RNA, 27 nt, Artificial Sequence
  Description of Artificial Sequence: Synthetic oligonucleotide
ggaauuccugugcaugaaagcacugac

SEQ ID NO: 4308 - RNA, 27 nt, Artificial Sequence
  Description of Artificial Sequence: Synthetic oligonucleotide
gaauuccugugcaugaaagcacugccc

SEQ ID NO: 4309 - RNA, 27 nt, Artificial Sequence
  Description of Artificial Sequence: Synthetic oligonucleotide
aauuccugugcaugaaagcacugcuca

SEQ ID NO: 4310 - RNA, 27 nt, Artificial Sequence
  Description of Artificial Sequence: Synthetic oligonucleotide
auuccugugcaugaaagcacugcuaac

SEQ ID NO: 4311 - RNA, 27 nt, Artificial Sequence
  Description of Artificial Sequence: Synthetic oligonucleotide
uuccugugcaugaaagcacugcuacca

SEQ ID NO: 4312 - RNA, 27 nt, Artificial Sequence
  Description of Artificial Sequence: Synthetic oligonucleotide
uccugugcaugaaagcacugcuacuac

SEQ ID NO: 4313 - RNA, 27 nt, Artificial Sequence
  Description of Artificial Sequence: Synthetic oligonucleotide
ccugugcaugaaagcacugcuacuccc

SEQ ID NO: 4314 - RNA, 27 nt, Artificial Sequence
  Description of Artificial Sequence: Synthetic oligonucleotide
uacucuucagcauuauuccaguggaca

SEQ ID NO: 4315 - RNA, 27 nt, Artificial Sequence
  Description of Artificial Sequence: Synthetic oligonucleotide
acucuucagcauuauuccaguggauaa

SEQ ID NO: 4316 - RNA, 27 nt, Artificial Sequence
  Description of Artificial Sequence: Synthetic oligonucleotide
cucuucagcauuauuccaguggaugaa

SEQ ID NO: 4317 - RNA, 27 nt, Artificial Sequence
  Description of Artificial Sequence: Synthetic oligonucleotide
ucuucagcauuauuccaguggauggaa

SEQ ID NO: 4318 - RNA, 27 nt, Artificial Sequence
  Description of Artificial Sequence: Synthetic oligonucleotide
cuucagcauuauuccaguggaugggac

SEQ ID NO: 4319 - RNA, 27 nt, Artificial Sequence
  Description of Artificial Sequence: Synthetic oligonucleotide
uucagcauuauuccaguggaugggcca

SEQ ID NO: 4320 - RNA, 27 nt, Artificial Sequence
  Description of Artificial Sequence: Synthetic oligonucleotide
ucagcauuauuccaguggaugggcuac

SEQ ID NO: 4321 - RNA, 27 nt, Artificial Sequence
  Description of Artificial Sequence: Synthetic oligonucleotide
cagcauuauuccaguggaugggcugcc

SEQ ID NO: 4322 - RNA, 27 nt, Artificial Sequence
  Description of Artificial Sequence: Synthetic oligonucleotide
agcauuauuccaguggaugggcugacc

SEQ ID NO: 4323 - RNA, 27 nt, Artificial Sequence
  Description of Artificial Sequence: Synthetic oligonucleotide
gcauuauuccaguggaugggcugaacc

SEQ ID NO: 4324 - RNA, 27 nt, Artificial Sequence
  Description of Artificial Sequence: Synthetic oligonucleotide
cauuauuccaguggaugggcugaaacc

SEQ ID NO: 4325 - RNA, 27 nt, Artificial Sequence
  Description of Artificial Sequence: Synthetic oligonucleotide
auuauuccaguggaugggcugaaaacc

SEQ ID NO: 4326 - RNA, 27 nt, Artificial Sequence
  Description of Artificial Sequence: Synthetic oligonucleotide
uuauuccaguggaugggcugaaaaaca

SEQ ID NO: 4327 - RNA, 27 nt, Artificial Sequence
  Description of Artificial Sequence: Synthetic oligonucleotide
uauuccaguggaugggcugaaaaauac

SEQ ID NO: 4328 - RNA, 27 nt, Artificial Sequence
  Description of Artificial Sequence: Synthetic oligonucleotide
auuccaguggaugggcugaaaaauccc

SEQ ID NO: 4329 - RNA, 27 nt, Artificial Sequence
  Description of Artificial Sequence: Synthetic oligonucleotide
uuccaguggaugggcugaaaaaucacc

SEQ ID NO: 4330 - RNA, 27 nt, Artificial Sequence
  Description of Artificial Sequence: Synthetic oligonucleotide
uccaguggaugggcugaaaaaucaacc

SEQ ID NO: 4331 - RNA, 27 nt, Artificial Sequence
  Description of Artificial Sequence: Synthetic oligonucleotide
ccaguggaugggcugaaaaaucaaacc

SEQ ID NO: 4332 - RNA, 27 nt, Artificial Sequence
  Description of Artificial Sequence: Synthetic oligonucleotide
caguggaugggcugaaaaaucaaaacc

SEQ ID NO: 4333 - RNA, 27 nt, Artificial Sequence
  Description of Artificial Sequence: Synthetic oligonucleotide
aguggaugggcugaaaaaucaaaaacc

SEQ ID NO: 4334 - RNA, 27 nt, Artificial Sequence
  Description of Artificial Sequence: Synthetic oligonucleotide
guggaugggcugaaaaaucaaaaauca

SEQ ID NO: 4335 - RNA, 27 nt, Artificial Sequence
  Description of Artificial Sequence: Synthetic oligonucleotide
uggaugggcugaaaaaucaaaaauuac

SEQ ID NO: 4336 - RNA, 27 nt, Artificial Sequence
  Description of Artificial Sequence: Synthetic oligonucleotide
ggaugggcugaaaaaucaaaaauuccc

SEQ ID NO: 4337 - RNA, 27 nt, Artificial Sequence
  Description of Artificial Sequence: Synthetic oligonucleotide
gaugggcugaaaaaucaaaaauucucc

SEQ ID NO: 4338 - RNA, 27 nt, Artificial Sequence
  Description of Artificial Sequence: Synthetic oligonucleotide
augggcugaaaaaucaaaaauucuuca

SEQ ID NO: 4339 - RNA, 27 nt, Artificial Sequence
  Description of Artificial Sequence: Synthetic oligonucleotide
ugggcugaaaaaucaaaaauucuuuac

SEQ ID NO: 4340 - RNA, 27 nt, Artificial Sequence
  Description of Artificial Sequence: Synthetic oligonucleotide
gggcugaaaaaucaaaaauucuuugcc

SEQ ID NO: 4341 - RNA, 27 nt, Artificial Sequence
  Description of Artificial Sequence: Synthetic oligonucleotide
ggcugaaaaaucaaaaauucuuugaca

SEQ ID NO: 4342 - RNA, 27 nt, Artificial Sequence
  Description of Artificial Sequence: Synthetic oligonucleotide
gcugaaaaaucaaaaauucuuugauac

SEQ ID NO: 4343 - RNA, 27 nt, Artificial Sequence
  Description of Artificial Sequence: Synthetic oligonucleotide
cugaaaaaucaaaaauucuuugaugcc

SEQ ID NO: 4344 - RNA, 27 nt, Artificial Sequence
  Description of Artificial Sequence: Synthetic oligonucleotide
ugaaaaaucaaaaauucuuugaugaca

SEQ ID NO: 4345 - RNA, 27 nt, Artificial Sequence
  Description of Artificial Sequence: Synthetic oligonucleotide
aaaaaucaaaaauucuuugaugaaccc

SEQ ID NO: 4346 - RNA, 27 nt, Artificial Sequence
  Description of Artificial Sequence: Synthetic oligonucleotide
aaaaucaaaaauucuuugaugaacuca

SEQ ID NO: 4347 - RNA, 27 nt, Artificial Sequence
  Description of Artificial Sequence: Synthetic oligonucleotide
aaaucaaaaauucuuugaugaacuuaa

SEQ ID NO: 4348 - RNA, 27 nt, Artificial Sequence
  Description of Artificial Sequence: Synthetic oligonucleotide
aaucaaaaauucuuugaugaacuucac

SEQ ID NO: 4349 - RNA, 27 nt, Artificial Sequence
  Description of Artificial Sequence: Synthetic oligonucleotide
aucaaaaauucuuugaugaacuucgcc

SEQ ID NO: 4350 - RNA, 27 nt, Artificial Sequence
  Description of Artificial Sequence: Synthetic oligonucleotide
ucaaaaauucuuugaugaacuucgacc

SEQ ID NO: 4351 - RNA, 27 nt, Artificial Sequence
  Description of Artificial Sequence: Synthetic oligonucleotide
caaaaauucuuugaugaacuucgaaca

SEQ ID NO: 4352 - RNA, 27 nt, Artificial Sequence
  Description of Artificial Sequence: Synthetic oligonucleotide
aaaaauucuuugaugaacuucgaauac

SEQ ID NO: 4353 - RNA, 27 nt, Artificial Sequence
  Description of Artificial Sequence: Synthetic oligonucleotide
aaaauucuuugaugaacuucgaaugcc

SEQ ID NO: 4354 - RNA, 27 nt, Artificial Sequence
  Description of Artificial Sequence: Synthetic oligonucleotide
aaauucuuugaugaacuucgaaugaca

SEQ ID NO: 4355 - RNA, 27 nt, Artificial Sequence
  Description of Artificial Sequence: Synthetic oligonucleotide
aauucuuugaugaacuucgaaugaaac

SEQ ID NO: 4356 - RNA, 27 nt, Artificial Sequence
  Description of Artificial Sequence: Synthetic oligonucleotide
auucuuugaugaacuucgaaugaaccc

SEQ ID NO: 4357 - RNA, 27 nt, Artificial Sequence
  Description of Artificial Sequence: Synthetic oligonucleotide
uucuuugaugaacuucgaaugaacuca

SEQ ID NO: 4358 - RNA, 27 nt, Artificial Sequence
  Description of Artificial Sequence: Synthetic oligonucleotide
ucuuugaugaacuucgaaugaacuaac

SEQ ID NO: 4359 - RNA, 27 nt, Artificial Sequence
  Description of Artificial Sequence: Synthetic oligonucleotide
cuuugaugaacuucgaaugaacuaccc

SEQ ID NO: 4360 - RNA, 27 nt, Artificial Sequence
  Description of Artificial Sequence: Synthetic oligonucleotide
uuugaugaacuucgaaugaacuacaca

SEQ ID NO: 4361 - RNA, 27 nt, Artificial Sequence
  Description of Artificial Sequence: Synthetic oligonucleotide
uugaugaacuucgaaugaacuacauac

SEQ ID NO: 4362 - RNA, 27 nt, Artificial Sequence
  Description of Artificial Sequence: Synthetic oligonucleotide
ugaugaacuucgaaugaacuacauccc

SEQ ID NO: 4363 - RNA, 27 nt, Artificial Sequence
  Description of Artificial Sequence: Synthetic oligonucleotide
gaugaacuucgaaugaacuacaucaca

SEQ ID NO: 4364 - RNA, 27 nt, Artificial Sequence
  Description of Artificial Sequence: Synthetic oligonucleotide
augaacuucgaaugaacuacaucaaaa

SEQ ID NO: 4365 - RNA, 27 nt, Artificial Sequence
  Description of Artificial Sequence: Synthetic oligonucleotide
ugaacuucgaaugaacuacaucaagac

SEQ ID NO: 4366 - RNA, 27 nt, Artificial Sequence
  Description of Artificial Sequence: Synthetic oligonucleotide
gaacuucgaaugaacuacaucaaggcc

SEQ ID NO: 4367 - RNA, 27 nt, Artificial Sequence
  Description of Artificial Sequence: Synthetic oligonucleotide
aacuucgaaugaacuacaucaaggaca

SEQ ID NO: 4368 - RNA, 27 nt, Artificial Sequence
  Description of Artificial Sequence: Synthetic oligonucleotide
acuucgaaugaacuacaucaaggaaac

SEQ ID NO: 4369 - RNA, 27 nt, Artificial Sequence
  Description of Artificial Sequence: Synthetic oligonucleotide
cuucgaaugaacuacaucaaggaacca

SEQ ID NO: 4370 - RNA, 27 nt, Artificial Sequence
  Description of Artificial Sequence: Synthetic oligonucleotide
uucgaaugaacuacaucaaggaacuaa

SEQ ID NO: 4371 - RNA, 27 nt, Artificial Sequence
  Description of Artificial Sequence: Synthetic oligonucleotide
ucgaaugaacuacaucaaggaacucac

SEQ ID NO: 4372 - RNA, 27 nt, Artificial Sequence
  Description of Artificial Sequence: Synthetic oligonucleotide
cgaaugaacuacaucaaggaacucgcc

SEQ ID NO: 4373 - RNA, 27 nt, Artificial Sequence
  Description of Artificial Sequence: Synthetic oligonucleotide
gaaugaacuacaucaaggaacucgaca

SEQ ID NO: 4374 - RNA, 27 nt, Artificial Sequence
  Description of Artificial Sequence: Synthetic oligonucleotide
aaugaacuacaucaaggaacucgauaa

SEQ ID NO: 4375 - RNA, 27 nt, Artificial Sequence
  Description of Artificial Sequence: Synthetic oligonucleotide
augaacuacaucaaggaacucgaucac

SEQ ID NO: 4376 - RNA, 27 nt, Artificial Sequence
  Description of Artificial Sequence: Synthetic oligonucleotide
ugaacuacaucaaggaacucgaucgcc

SEQ ID NO: 4377 - RNA, 27 nt, Artificial Sequence
  Description of Artificial Sequence: Synthetic oligonucleotide
gaacuacaucaaggaacucgaucgucc

SEQ ID NO: 4378 - RNA, 27 nt, Artificial Sequence
  Description of Artificial Sequence: Synthetic oligonucleotide
aacuacaucaaggaacucgaucguaca

SEQ ID NO: 4379 - RNA, 27 nt, Artificial Sequence
  Description of Artificial Sequence: Synthetic oligonucleotide
acuacaucaaggaacucgaucguauac

SEQ ID NO: 4380 - RNA, 27 nt, Artificial Sequence
  Description of Artificial Sequence: Synthetic oligonucleotide
cuacaucaaggaacucgaucguauccc

SEQ ID NO: 4381 - RNA, 27 nt, Artificial Sequence
  Description of Artificial Sequence: Synthetic oligonucleotide
guaucauugcaugcaaaagaaaaaaca

SEQ ID NO: 4382 - RNA, 27 nt, Artificial Sequence
  Description of Artificial Sequence: Synthetic oligonucleotide
uaucauugcaugcaaaagaaaaaauaa

SEQ ID NO: 4383 - RNA, 27 nt, Artificial Sequence
  Description of Artificial Sequence: Synthetic oligonucleotide
aaaaucccacauccugcucaagacgac

SEQ ID NO: 4384 - RNA, 27 nt, Artificial Sequence
  Description of Artificial Sequence: Synthetic oligonucleotide
aaaucccacauccugcucaagacgccc

SEQ ID NO: 4385 - RNA, 27 nt, Artificial Sequence
  Description of Artificial Sequence: Synthetic oligonucleotide
gacgcuucuaccagcucaccaagcuaa

SEQ ID NO: 4386 - RNA, 27 nt, Artificial Sequence
  Description of Artificial Sequence: Synthetic oligonucleotide
acgcuucuaccagcucaccaagcucac

SEQ ID NO: 4387 - RNA, 27 nt, Artificial Sequence
  Description of Artificial Sequence: Synthetic oligonucleotide
cgcuucuaccagcucaccaagcuccca

SEQ ID NO: 4388 - RNA, 27 nt, Artificial Sequence
  Description of Artificial Sequence: Synthetic oligonucleotide
gcuucuaccagcucaccaagcuccuaa

SEQ ID NO: 4389 - RNA, 27 nt, Artificial Sequence
  Description of Artificial Sequence: Synthetic oligonucleotide
cuucuaccagcucaccaagcuccugac

SEQ ID NO: 4390 - RNA, 27 nt, Artificial Sequence
  Description of Artificial Sequence: Synthetic oligonucleotide
uucuaccagcucaccaagcuccuggca

SEQ ID NO: 4391 - RNA, 27 nt, Artificial Sequence
  Description of Artificial Sequence: Synthetic oligonucleotide
ucuaccagcucaccaagcuccuggaac

SEQ ID NO: 4392 - RNA, 27 nt, Artificial Sequence
  Description of Artificial Sequence: Synthetic oligonucleotide
cuaccagcucaccaagcuccuggacca

SEQ ID NO: 4393 - RNA, 27 nt, Artificial Sequence
  Description of Artificial Sequence: Synthetic oligonucleotide
uaccagcucaccaagcuccuggacuaa

SEQ ID NO: 4394 - RNA, 27 nt, Artificial Sequence
  Description of Artificial Sequence: Synthetic oligonucleotide
accagcucaccaagcuccuggacucaa

SEQ ID NO: 4395 - RNA, 27 nt, Artificial Sequence
  Description of Artificial Sequence: Synthetic oligonucleotide
ccagcucaccaagcuccuggacuccac

SEQ ID NO: 4396 - RNA, 27 nt, Artificial Sequence
  Description of Artificial Sequence: Synthetic oligonucleotide
agcucaccaagcuccuggacuccguaa

SEQ ID NO: 4397 - RNA, 27 nt, Artificial Sequence
  Description of Artificial Sequence: Synthetic oligonucleotide
agcuccuggacuccgugcagccuauca

SEQ ID NO: 4398 - RNA, 27 nt, Artificial Sequence
  Description of Artificial Sequence: Synthetic oligonucleotide
uccgugcagccuauugcgagagagcca

SEQ ID NO: 4399 - RNA, 27 nt, Artificial Sequence
  Description of Artificial Sequence: Synthetic oligonucleotide
cgagagagcugcaucaguucacuuuca

SEQ ID NO: 4400 - RNA, 27 nt, Artificial Sequence
  Description of Artificial Sequence: Synthetic oligonucleotide
gagagagcugcaucaguucacuuuuac

SEQ ID NO: 4401 - RNA, 27 nt, Artificial Sequence
  Description of Artificial Sequence: Synthetic oligonucleotide
agagagcugcaucaguucacuuuugca

SEQ ID NO: 4402 - RNA, 27 nt, Artificial Sequence
  Description of Artificial Sequence: Synthetic oligonucleotide
gagagcugcaucaguucacuuuugaaa

SEQ ID NO: 4403 - RNA, 27 nt, Artificial Sequence
  Description of Artificial Sequence: Synthetic oligonucleotide
agagcugcaucaguucacuuuugacac

SEQ ID NO: 4404 - RNA, 27 nt, Artificial Sequence
  Description of Artificial Sequence: Synthetic oligonucleotide
gagcugcaucaguucacuuuugaccca

SEQ ID NO: 4405 - RNA, 27 nt, Artificial Sequence
  Description of Artificial Sequence: Synthetic oligonucleotide
agcugcaucaguucacuuuugaccuaa

SEQ ID NO: 4406 - RNA, 27 nt, Artificial Sequence
  Description of Artificial Sequence: Synthetic oligonucleotide
gcugcaucaguucacuuuugaccugac

SEQ ID NO: 4407 - RNA, 27 nt, Artificial Sequence
  Description of Artificial Sequence: Synthetic oligonucleotide
cugcaucaguucacuuuugaccugccc

SEQ ID NO: 4408 - RNA, 27 nt, Artificial Sequence
  Description of Artificial Sequence: Synthetic oligonucleotide
ugcaucaguucacuuuugaccugcucc

SEQ ID NO: 4409 - RNA, 27 nt, Artificial Sequence
  Description of Artificial Sequence: Synthetic oligonucleotide
gcaucaguucacuuuugaccugcuacc

SEQ ID NO: 4410 - RNA, 27 nt, Artificial Sequence
  Description of Artificial Sequence: Synthetic oligonucleotide
caucaguucacuuuugaccugcuaaca

SEQ ID NO: 4411 - RNA, 27 nt, Artificial Sequence
  Description of Artificial Sequence: Synthetic oligonucleotide
aucaguucacuuuugaccugcuaauac

SEQ ID NO: 4412 - RNA, 27 nt, Artificial Sequence
  Description of Artificial Sequence: Synthetic oligonucleotide
ucaguucacuuuugaccugcuaauccc

SEQ ID NO: 4413 - RNA, 27 nt, Artificial Sequence
  Description of Artificial Sequence: Synthetic oligonucleotide
caguucacuuuugaccugcuaaucaca

SEQ ID NO: 4414 - RNA, 27 nt, Artificial Sequence
  Description of Artificial Sequence: Synthetic oligonucleotide
aguucacuuuugaccugcuaaucaaac

SEQ ID NO: 4415 - RNA, 27 nt, Artificial Sequence
  Description of Artificial Sequence: Synthetic oligonucleotide
guucacuuuugaccugcuaaucaagca

SEQ ID NO: 4416 - RNA, 27 nt, Artificial Sequence
  Description of Artificial Sequence: Synthetic oligonucleotide
uucacuuuugaccugcuaaucaaguac

SEQ ID NO: 4417 - RNA, 27 nt, Artificial Sequence
  Description of Artificial Sequence: Synthetic oligonucleotide
ucacuuuugaccugcuaaucaagucca

SEQ ID NO: 4418 - RNA, 27 nt, Artificial Sequence
  Description of Artificial Sequence: Synthetic oligonucleotide
cacuuuugaccugcuaaucaagucaac

SEQ ID NO: 4419 - RNA, 27 nt, Artificial Sequence
  Description of Artificial Sequence: Synthetic oligonucleotide
acuuuugaccugcuaaucaagucacca

SEQ ID NO: 4420 - RNA, 27 nt, Artificial Sequence
  Description of Artificial Sequence: Synthetic oligonucleotide
acauggugagcguggacuuuccggacc

SEQ ID NO: 4421 - RNA, 27 nt, Artificial Sequence
  Description of Artificial Sequence: Synthetic oligonucleotide
cauggugagcguggacuuuccggaacc

SEQ ID NO: 4422 - RNA, 27 nt, Artificial Sequence
  Description of Artificial Sequence: Synthetic oligonucleotide
cggaaaugauggcagagaucaucucca

SEQ ID NO: 4423 - RNA, 27 nt, Artificial Sequence
  Description of Artificial Sequence: Synthetic oligonucleotide
ggaaaugauggcagagaucaucucuac

SEQ ID NO: 4424 - RNA, 27 nt, Artificial Sequence
  Description of Artificial Sequence: Synthetic oligonucleotide
gaaaugauggcagagaucaucucugca

SEQ ID NO: 4425 - RNA, 27 nt, Artificial Sequence
  Description of Artificial Sequence: Synthetic oligonucleotide
aaaugauggcagagaucaucucuguaa

SEQ ID NO: 4426 - RNA, 27 nt, Artificial Sequence
  Description of Artificial Sequence: Synthetic oligonucleotide
aaugauggcagagaucaucucugugac

SEQ ID NO: 4427 - RNA, 27 nt, Artificial Sequence
  Description of Artificial Sequence: Synthetic oligonucleotide
augauggcagagaucaucucugugccc

SEQ ID NO: 4428 - RNA, 27 nt, Artificial Sequence
  Description of Artificial Sequence: Synthetic oligonucleotide
ugauggcagagaucaucucugugcaca

SEQ ID NO: 4429 - RNA, 27 nt, Artificial Sequence
  Description of Artificial Sequence: Synthetic oligonucleotide
gauggcagagaucaucucugugcaaac

SEQ ID NO: 4430 - RNA, 27 nt, Artificial Sequence
  Description of Artificial Sequence: Synthetic oligonucleotide
auggcagagaucaucucugugcaagca

SEQ ID NO: 4431 - RNA, 27 nt, Artificial Sequence
  Description of Artificial Sequence: Synthetic oligonucleotide
uggcagagaucaucucugugcaaguaa

SEQ ID NO: 4432 - RNA, 27 nt, Artificial Sequence
  Description of Artificial Sequence: Synthetic oligonucleotide
ggcagagaucaucucugugcaagugaa

SEQ ID NO: 4433 - RNA, 27 nt, Artificial Sequence
  Description of Artificial Sequence: Synthetic oligonucleotide
gcagagaucaucucugugcaagugcaa

SEQ ID NO: 4434 - RNA, 27 nt, Artificial Sequence
  Description of Artificial Sequence: Synthetic oligonucleotide
cagagaucaucucugugcaagugccac

SEQ ID NO: 4435 - RNA, 27 nt, Artificial Sequence
  Description of Artificial Sequence: Synthetic oligonucleotide
agagaucaucucugugcaagugccccc

SEQ ID NO: 4436 - RNA, 27 nt, Artificial Sequence
  Description of Artificial Sequence: Synthetic oligonucleotide
gagaucaucucugugcaagugcccaca

SEQ ID NO: 4437 - RNA, 27 nt, Artificial Sequence
  Description of Artificial Sequence: Synthetic oligonucleotide
agaucaucucugugcaagugcccaaac

SEQ ID NO: 4438 - RNA, 27 nt, Artificial Sequence
  Description of Artificial Sequence: Synthetic oligonucleotide
gaucaucucugugcaagugcccaagcc

SEQ ID NO: 4439 - RNA, 27 nt, Artificial Sequence
  Description of Artificial Sequence: Synthetic oligonucleotide
aucaucucugugcaagugcccaagaca

SEQ ID NO: 4440 - RNA, 27 nt, Artificial Sequence
  Description of Artificial Sequence: Synthetic oligonucleotide
ucaucucugugcaagugcccaagauaa

SEQ ID NO: 4441 - RNA, 27 nt, Artificial Sequence
  Description of Artificial Sequence: Synthetic oligonucleotide
caucucugugcaagugcccaagaucac

SEQ ID NO: 4442 - RNA, 27 nt, Artificial Sequence
  Description of Artificial Sequence: Synthetic oligonucleotide
aucucugugcaagugcccaagaucccc

SEQ ID NO: 4443 - RNA, 27 nt, Artificial Sequence
  Description of Artificial Sequence: Synthetic oligonucleotide
ucucugugcaagugcccaagauccucc

SEQ ID NO: 4444 - RNA, 27 nt, Artificial Sequence
  Description of Artificial Sequence: Synthetic oligonucleotide
cucugugcaagugcccaagauccuuca

SEQ ID NO: 4445 - RNA, 27 nt, Artificial Sequence
  Description of Artificial Sequence: Synthetic oligonucleotide
ucugugcaagugcccaagauccuuuac

SEQ ID NO: 4446 - RNA, 27 nt, Artificial Sequence
  Description of Artificial Sequence: Synthetic oligonucleotide
cugugcaagugcccaagauccuuucca

SEQ ID NO: 4447 - RNA, 27 nt, Artificial Sequence
  Description of Artificial Sequence: Synthetic oligonucleotide
ugugcaagugcccaagauccuuucuaa

SEQ ID NO: 4448 - RNA, 27 nt, Artificial Sequence
  Description of Artificial Sequence: Synthetic oligonucleotide
gugcaagugcccaagauccuuucugaa

SEQ ID NO: 4449 - RNA, 27 nt, Artificial Sequence
  Description of Artificial Sequence: Synthetic oligonucleotide
ugcaagugcccaagauccuuucuggac

SEQ ID NO: 4450 - RNA, 27 nt, Artificial Sequence
  Description of Artificial Sequence: Synthetic oligonucleotide
gcaagugcccaagauccuuucugggcc

SEQ ID NO: 4451 - RNA, 27 nt, Artificial Sequence
  Description of Artificial Sequence: Synthetic oligonucleotide
caagugcccaagauccuuucugggacc

SEQ ID NO: 4452 - RNA, 27 nt, Artificial Sequence
  Description of Artificial Sequence: Synthetic oligonucleotide
aagugcccaagauccuuucugggaaca

SEQ ID NO: 4453 - RNA, 27 nt, Artificial Sequence
  Description of Artificial Sequence: Synthetic oligonucleotide
agugcccaagauccuuucugggaaaac

SEQ ID NO: 4454 - RNA, 27 nt, Artificial Sequence
  Description of Artificial Sequence: Synthetic oligonucleotide
gugcccaagauccuuucugggaaagca

SEQ ID NO: 4455 - RNA, 27 nt, Artificial Sequence
  Description of Artificial Sequence: Synthetic oligonucleotide
ugcccaagauccuuucugggaaaguac

SEQ ID NO: 4456 - RNA, 27 nt, Artificial Sequence
  Description of Artificial Sequence: Synthetic oligonucleotide
gcccaagauccuuucugggaaaguccc

SEQ ID NO: 4457 - RNA, 27 nt, Artificial Sequence
  Description of Artificial Sequence: Synthetic oligonucleotide
cccaagauccuuucugggaaagucaca

SEQ ID NO: 4458 - RNA, 27 nt, Artificial Sequence
  Description of Artificial Sequence: Synthetic oligonucleotide
ccaagauccuuucugggaaagucaaaa

SEQ ID NO: 4459 - RNA, 27 nt, Artificial Sequence
  Description of Artificial Sequence: Synthetic oligonucleotide
caagauccuuucugggaaagucaagaa

SEQ ID NO: 4460 - RNA, 27 nt, Artificial Sequence
  Description of Artificial Sequence: Synthetic oligonucleotide
aagauccuuucugggaaagucaagcaa

SEQ ID NO: 4461 - RNA, 27 nt, Artificial Sequence
  Description of Artificial Sequence: Synthetic oligonucleotide
agauccuuucugggaaagucaagccac

SEQ ID NO: 4462 - RNA, 27 nt, Artificial Sequence
  Description of Artificial Sequence: Synthetic oligonucleotide
gauccuuucugggaaagucaagccccc

SEQ ID NO: 4463 - RNA, 27 nt, Artificial Sequence
  Description of Artificial Sequence: Synthetic oligonucleotide
auccuuucugggaaagucaagcccaca

SEQ ID NO: 4464 - RNA, 27 nt, Artificial Sequence
  Description of Artificial Sequence: Synthetic oligonucleotide
uccuuucugggaaagucaagcccauac

SEQ ID NO: 4465 - RNA, 27 nt, Artificial Sequence
  Description of Artificial Sequence: Synthetic oligonucleotide
ccuuucugggaaagucaagcccauccc

SEQ ID NO: 4466 - RNA, 27 nt, Artificial Sequence
  Description of Artificial Sequence: Synthetic oligonucleotide
cuuucugggaaagucaagcccaucucc

SEQ ID NO: 4467 - RNA, 27 nt, Artificial Sequence
  Description of Artificial Sequence: Synthetic oligonucleotide
uuucugggaaagucaagcccaucuacc

SEQ ID NO: 4468 - RNA, 27 nt, Artificial Sequence
  Description of Artificial Sequence: Synthetic oligonucleotide
uucugggaaagucaagcccaucuaucc

SEQ ID NO: 4469 - RNA, 27 nt, Artificial Sequence
  Description of Artificial Sequence: Synthetic oligonucleotide
ucugggaaagucaagcccaucuauuca

SEQ ID NO: 4470 - RNA, 27 nt, Artificial Sequence
  Description of Artificial Sequence: Synthetic oligonucleotide
cugggaaagucaagcccaucuauuuaa

SEQ ID NO: 4471 - RNA, 27 nt, Artificial Sequence
  Description of Artificial Sequence: Synthetic oligonucleotide
ugggaaagucaagcccaucuauuucac

SEQ ID NO: 4472 - RNA, 27 nt, Artificial Sequence
  Description of Artificial Sequence: Synthetic oligonucleotide
gggaaagucaagcccaucuauuuccca

SEQ ID NO: 4473 - RNA, 27 nt, Artificial Sequence
  Description of Artificial Sequence: Synthetic oligonucleotide
ggaaagucaagcccaucuauuuccaac

SEQ ID NO: 4474 - RNA, 27 nt, Artificial Sequence
  Description of Artificial Sequence: Synthetic oligonucleotide
gaaagucaagcccaucuauuuccacca

SEQ ID NO: 4475 - RNA, 27 nt, Artificial Sequence
  Description of Artificial Sequence: Synthetic oligonucleotide
uucagaugucuucugccuguuauaaac

SEQ ID NO: 4476 - RNA, 27 nt, Artificial Sequence
  Description of Artificial Sequence: Synthetic oligonucleotide
ucagaugucuucugccuguuauaacca

SEQ ID NO: 4477 - RNA, 27 nt, Artificial Sequence
  Description of Artificial Sequence: Synthetic oligonucleotide
cagaugucuucugccuguuauaacuac

SEQ ID NO: 4478 - RNA, 27 nt, Artificial Sequence
  Description of Artificial Sequence: Synthetic oligonucleotide
agaugucuucugccuguuauaacucca

SEQ ID NO: 4479 - RNA, 27 nt, Artificial Sequence
  Description of Artificial Sequence: Synthetic oligonucleotide
ggggaauuuccucuauugauguacaac

SEQ ID NO: 4480 - RNA, 27 nt, Artificial Sequence
  Description of Artificial Sequence: Synthetic oligonucleotide
uugcugggcuuuuuuuuucucuuucca

SEQ ID NO: 4481 - RNA, 27 nt, Artificial Sequence
  Description of Artificial Sequence: Synthetic oligonucleotide
ugcugggcuuuuuuuuucucuuucuac

SEQ ID NO: 4482 - RNA, 27 nt, Artificial Sequence
  Description of Artificial Sequence: Synthetic oligonucleotide
gcuuuuuuuuucucuuucucuccuuca

SEQ ID NO: 4483 - RNA, 27 nt, Artificial Sequence
  Description of Artificial Sequence: Synthetic oligonucleotide
uuuuuucucuuucucuccuuucuuucc

SEQ ID NO: 4484 - RNA, 27 nt, Artificial Sequence
  Description of Artificial Sequence: Synthetic oligonucleotide
ucuuuuucuucuucccucccuaucucc

SEQ ID NO: 4485 - RNA, 27 nt, Artificial Sequence
  Description of Artificial Sequence: Synthetic oligonucleotide
uguuguaugccuuuaaaucugugauac

SEQ ID NO: 4486 - RNA, 27 nt, Artificial Sequence
  Description of Artificial Sequence: Synthetic oligonucleotide
ugugcuuguuuacagcacuacucugca

SEQ ID NO: 4487 - RNA, 27 nt, Artificial Sequence
  Description of Artificial Sequence: Synthetic oligonucleotide
uuagagagcuaagauuaucuggggacc

SEQ ID NO: 4488 - RNA, 27 nt, Artificial Sequence
  Description of Artificial Sequence: Synthetic oligonucleotide
ggggaaaucaaaacaaaaacaagcacc

SEQ ID NO: 4489 - RNA, 27 nt, Artificial Sequence
  Description of Artificial Sequence: Synthetic oligonucleotide
cugugcaugaaagcacugcugcucuca

SEQ ID NO: 4490 - RNA, 27 nt, Artificial Sequence
  Description of Artificial Sequence: Synthetic oligonucleotide
caugaaagcacugcugcucuucagccc

SEQ ID NO: 4491 - RNA, 27 nt, Artificial Sequence
  Description of Artificial Sequence: Synthetic oligonucleotide
agcacugcugcucuucagcauuauuaa

SEQ ID NO: 4492 - RNA, 27 nt, Artificial Sequence
  Description of Artificial Sequence: Synthetic oligonucleotide
ugcugcucuucagcauuauuccaguaa

SEQ ID NO: 4493 - RNA, 27 nt, Artificial Sequence
  Description of Artificial Sequence: Synthetic oligonucleotide
agcucaccaagcuccuggauucuguaa

SEQ ID NO: 4494 - RNA, 27 nt, Artificial Sequence
  Description of Artificial Sequence: Synthetic oligonucleotide
agcuccuggauucugugcagccuauca

SEQ ID NO: 4495 - RNA, 27 nt, Artificial Sequence
  Description of Artificial Sequence: Synthetic oligonucleotide
cuggauucugugcagccuauugcaaac

SEQ ID NO: 4496 - RNA, 27 nt, Artificial Sequence
  Description of Artificial Sequence: Synthetic oligonucleotide
ucugugcagccuauugcaagagagcca

SEQ ID NO: 4497 - RNA, 27 nt, Artificial Sequence
  Description of Artificial Sequence: Synthetic oligonucleotide
cagccuauugcaagagagcugcaucca

SEQ ID NO: 4498 - RNA, 27 nt, Artificial Sequence
  Description of Artificial Sequence: Synthetic oligonucleotide
gcguggacuuuccugaaaugauggcca

SEQ ID NO: 4499 - RNA, 27 nt, Artificial Sequence
  Description of Artificial Sequence: Synthetic oligonucleotide
ucuucugccuguuauauaacucugcca

SEQ ID NO: 4500 - RNA, 27 nt, Artificial Sequence
  Description of Artificial Sequence: Synthetic oligonucleotide
ugcacuacuucucugcagugccuugaa

SEQ ID NO: 4501 - RNA, 27 nt, Artificial Sequence
  Description of Artificial Sequence: Synthetic oligonucleotide
uccugggcuucuccuucuuuuuuuuca

SEQ ID NO: 4502 - RNA, 27 nt, Artificial Sequence
  Description of Artificial Sequence: Synthetic oligonucleotide
gcuucuccuucuuuuuuuuucuucuca

SEQ ID NO: 4503 - RNA, 27 nt, Artificial Sequence
  Description of Artificial Sequence: Synthetic oligonucleotide
uucuuuuuuuuucuucuucccucccca

SEQ ID NO: 4504 - RNA, 27 nt, Artificial Sequence
  Description of Artificial Sequence: Synthetic oligonucleotide
cugcugcguauuguggcuccugccucc

SEQ ID NO: 4505 - RNA, 27 nt, Artificial Sequence
  Description of Artificial Sequence: Synthetic oligonucleotide
uguggcuccugccuuuguuuugauuca

SEQ ID NO: 4506 - RNA, 27 nt, Artificial Sequence
  Description of Artificial Sequence: Synthetic oligonucleotide
cuccugccuuuguuuugauuucuguca

SEQ ID NO: 4507 - RNA, 27 nt, Artificial Sequence
  Description of Artificial Sequence: Synthetic oligonucleotide
ugaaguuuuuaaaagcugcuaaagacu

SEQ ID NO: 4508 - RNA, 27 nt, Artificial Sequence
  Description of Artificial Sequence: Synthetic oligonucleotide
gaaguuuuuaaaagcugcuaaagacuc

SEQ ID NO: 4509 - RNA, 27 nt, Artificial Sequence
  Description of Artificial Sequence: Synthetic oligonucleotide
aaguuuuuaaaagcugcuaaagacucg

SEQ ID NO: 4510 - RNA, 27 nt, Artificial Sequence
  Description of Artificial Sequence: Synthetic oligonucleotide
ugcggagccagagaucaaaagaugaaa

SEQ ID NO: 4511 - RNA, 27 nt, Artificial Sequence
  Description of Artificial Sequence: Synthetic oligonucleotide
gccagagaucaaaagaugaaaaggcag

SEQ ID NO: 4512 - RNA, 27 nt, Artificial Sequence
  Description of Artificial Sequence: Synthetic oligonucleotide
ccagagaucaaaagaugaaaaggcagu

SEQ ID NO: 4513 - RNA, 27 nt, Artificial Sequence
  Description of Artificial Sequence: Synthetic oligonucleotide
caaaagaugaaaaggcagucaggucuu

SEQ ID NO: 4514 - RNA, 27 nt, Artificial Sequence
  Description of Artificial Sequence: Synthetic oligonucleotide
aaaagaugaaaaggcagucaggucuuc

SEQ ID NO: 4515 - RNA, 27 nt, Artificial Sequence
  Description of Artificial Sequence: Synthetic oligonucleotide
gucaggucuucaguagccaaaaaacaa

SEQ ID NO: 4516 - RNA, 27 nt, Artificial Sequence
  Description of Artificial Sequence: Synthetic oligonucleotide
ucaggucuucaguagccaaaaaacaaa

SEQ ID NO: 4517 - RNA, 27 nt, Artificial Sequence
  Description of Artificial Sequence: Synthetic oligonucleotide
caguagccaaaaaacaaaacaaacaaa

SEQ ID NO: 4518 - RNA, 27 nt, Artificial Sequence
  Description of Artificial Sequence: Synthetic oligonucleotide
gccaaaaaacaaaacaaacaaaaacaa

SEQ ID NO: 4519 - RNA, 27 nt, Artificial Sequence
  Description of Artificial Sequence: Synthetic oligonucleotide
ccaaaaaacaaaacaaacaaaaacaaa

SEQ ID NO: 4520 - RNA, 27 nt, Artificial Sequence
  Description of Artificial Sequence: Synthetic oligonucleotide
acaaaacaaacaaaaacaaaaaagccg

SEQ ID NO: 4521 - RNA, 27 nt, Artificial Sequence
  Description of Artificial Sequence: Synthetic oligonucleotide
aacaaaaacaaaaaagccgaaauaaaa

SEQ ID NO: 4522 - RNA, 27 nt, Artificial Sequence
  Description of Artificial Sequence: Synthetic oligonucleotide
acaaaaacaaaaaagccgaaauaaaag

SEQ ID NO: 4523 - RNA, 27 nt, Artificial Sequence
  Description of Artificial Sequence: Synthetic oligonucleotide
caaaaacaaaaaagccgaaauaaaaga

SEQ ID NO: 4524 - RNA, 27 nt, Artificial Sequence
  Description of Artificial Sequence: Synthetic oligonucleotide
acaaaaaagccgaaauaaaagaaaaag

SEQ ID NO: 4525 - RNA, 27 nt, Artificial Sequence
  Description of Artificial Sequence: Synthetic oligonucleotide
caaaaaagccgaaauaaaagaaaaaga

SEQ ID NO: 4526 - RNA, 27 nt, Artificial Sequence
  Description of Artificial Sequence: Synthetic oligonucleotide
aaaaagccgaaauaaaagaaaaagaua

SEQ ID NO: 4527 - RNA, 27 nt, Artificial Sequence
  Description of Artificial Sequence: Synthetic oligonucleotide
gccgaaauaaaagaaaaagauaauaac

SEQ ID NO: 4528 - RNA, 27 nt, Artificial Sequence
  Description of Artificial Sequence: Synthetic oligonucleotide
ccgaaauaaaagaaaaagauaauaacu

SEQ ID NO: 4529 - RNA, 27 nt, Artificial Sequence
  Description of Artificial Sequence: Synthetic oligonucleotide
cgaaauaaaagaaaaagauaauaacuc

SEQ ID NO: 4530 - RNA, 27 nt, Artificial Sequence
  Description of Artificial Sequence: Synthetic oligonucleotide
aagaaaaagauaauaacucaguucuua

SEQ ID NO: 4531 - RNA, 27 nt, Artificial Sequence
  Description of Artificial Sequence: Synthetic oligonucleotide
aaaagauaauaacucaguucuuauuug

SEQ ID NO: 4532 - RNA, 27 nt, Artificial Sequence
  Description of Artificial Sequence: Synthetic oligonucleotide
aaagauaauaacucaguucuuauuugc

SEQ ID NO: 4533 - RNA, 27 nt, Artificial Sequence
  Description of Artificial Sequence: Synthetic oligonucleotide
agauaauaacucaguucuuauuugcac

SEQ ID NO: 4534 - RNA, 27 nt, Artificial Sequence
  Description of Artificial Sequence: Synthetic oligonucleotide
gauaauaacucaguucuuauuugcacc

SEQ ID NO: 4535 - RNA, 27 nt, Artificial Sequence
  Description of Artificial Sequence: Synthetic oligonucleotide
ucuuauuugcaccuacuucaguggaca

SEQ ID NO: 4536 - RNA, 27 nt, Artificial Sequence
  Description of Artificial Sequence: Synthetic oligonucleotide
ucaguggacacugaauuuggaaggugg

SEQ ID NO: 4537 - RNA, 27 nt, Artificial Sequence
  Description of Artificial Sequence: Synthetic oligonucleotide
cacugaauuuggaagguggaggauuuu

SEQ ID NO: 4538 - RNA, 27 nt, Artificial Sequence
  Description of Artificial Sequence: Synthetic oligonucleotide
uuuggaagguggaggauuuuguuuuuu

SEQ ID NO: 4539 - RNA, 27 nt, Artificial Sequence
  Description of Artificial Sequence: Synthetic oligonucleotide
ggaagguggaggauuuuguuuuuuucu

SEQ ID NO: 4540 - RNA, 27 nt, Artificial Sequence
  Description of Artificial Sequence: Synthetic oligonucleotide
uggaggauuuuguuuuuuucuuuuaag

SEQ ID NO: 4541 - RNA, 27 nt, Artificial Sequence
  Description of Artificial Sequence: Synthetic oligonucleotide
ggaggauuuuguuuuuuucuuuuaaga

SEQ ID NO: 4542 - RNA, 27 nt, Artificial Sequence
  Description of Artificial Sequence: Synthetic oligonucleotide
aggauuuuguuuuuuucuuuuaagauc

SEQ ID NO: 4543 - RNA, 27 nt, Artificial Sequence
  Description of Artificial Sequence: Synthetic oligonucleotide
ggauuuuguuuuuuucuuuuaagaucu

SEQ ID NO: 4544 - RNA, 27 nt, Artificial Sequence
  Description of Artificial Sequence: Synthetic oligonucleotide
gauuuuguuuuuuucuuuuaagaucug

SEQ ID NO: 4545 - RNA, 27 nt, Artificial Sequence
  Description of Artificial Sequence: Synthetic oligonucleotide
auuuuguuuuuuucuuuuaagaucugg

SEQ ID NO: 4546 - RNA, 27 nt, Artificial Sequence
  Description of Artificial Sequence: Synthetic oligonucleotide
uguuuuuuucuuuuaagaucugggcau

SEQ ID NO: 4547 - RNA, 27 nt, Artificial Sequence
  Description of Artificial Sequence: Synthetic oligonucleotide
guuuuuuucuuuuaagaucugggcauc

SEQ ID NO: 4548 - RNA, 27 nt, Artificial Sequence
  Description of Artificial Sequence: Synthetic oligonucleotide
uuuaagaucugggcaucuuuugaaucu

SEQ ID NO: 4549 - RNA, 27 nt, Artificial Sequence
  Description of Artificial Sequence: Synthetic oligonucleotide
aucuuuugaaucuacccuucaaguauu

SEQ ID NO: 4550 - RNA, 27 nt, Artificial Sequence
  Description of Artificial Sequence: Synthetic oligonucleotide
ucuuuugaaucuacccuucaaguauua

SEQ ID NO: 4551 - RNA, 27 nt, Artificial Sequence
  Description of Artificial Sequence: Synthetic oligonucleotide
cuuuugaaucuacccuucaaguauuaa

SEQ ID NO: 4552 - RNA, 27 nt, Artificial Sequence
  Description of Artificial Sequence: Synthetic oligonucleotide
uuuugaaucuacccuucaaguauuaag

SEQ ID NO: 4553 - RNA, 27 nt, Artificial Sequence
  Description of Artificial Sequence: Synthetic oligonucleotide
uuugaaucuacccuucaaguauuaaga

SEQ ID NO: 4554 - RNA, 27 nt, Artificial Sequence
  Description of Artificial Sequence: Synthetic oligonucleotide
ucaaguauuaagagacagacugugagc

SEQ ID NO: 4555 - RNA, 27 nt, Artificial Sequence
  Description of Artificial Sequence: Synthetic oligonucleotide
aguauuaagagacagacugugagccua

SEQ ID NO: 4556 - RNA, 27 nt, Artificial Sequence
  Description of Artificial Sequence: Synthetic oligonucleotide
cuguugaacucuucugagcaagagaag

SEQ ID NO: 4557 - RNA, 27 nt, Artificial Sequence
  Description of Artificial Sequence: Synthetic oligonucleotide
uguugaacucuucugagcaagagaagg

SEQ ID NO: 4558 - RNA, 27 nt, Artificial Sequence
  Description of Artificial Sequence: Synthetic oligonucleotide
caaggauggaagugcaguuagggcugg

SEQ ID NO: 4559 - RNA, 27 nt, Artificial Sequence
  Description of Artificial Sequence: Synthetic oligonucleotide
ccgaggagcuuuccagaaucuguucca

SEQ ID NO: 4560 - RNA, 27 nt, Artificial Sequence
  Description of Artificial Sequence: Synthetic oligonucleotide
cgaggagcuuuccagaaucuguuccag

SEQ ID NO: 4561 - RNA, 27 nt, Artificial Sequence
  Description of Artificial Sequence: Synthetic oligonucleotide
cgcugaccuuaaagacauccugagcga

SEQ ID NO: 4562 - RNA, 27 nt, Artificial Sequence
  Description of Artificial Sequence: Synthetic oligonucleotide
uccaaggacaauuacuuagggggcacu

SEQ ID NO: 4563 - RNA, 27 nt, Artificial Sequence
  Description of Artificial Sequence: Synthetic oligonucleotide
ccaaggaguuguguaaggcagugucgg

SEQ ID NO: 4564 - RNA, 27 nt, Artificial Sequence
  Description of Artificial Sequence: Synthetic oligonucleotide
cacugaagauacugcugaguauucccc

SEQ ID NO: 4565 - RNA, 27 nt, Artificial Sequence
  Description of Artificial Sequence: Synthetic oligonucleotide
ugcugaguauuccccuuucaagggagg

SEQ ID NO: 4566 - RNA, 27 nt, Artificial Sequence
  Description of Artificial Sequence: Synthetic oligonucleotide
cacuugugucaaaagcgaaaugggccc

SEQ ID NO: 4567 - RNA, 27 nt, Artificial Sequence
  Description of Artificial Sequence: Synthetic oligonucleotide
acuugugucaaaagcgaaaugggcccc

SEQ ID NO: 4568 - RNA, 27 nt, Artificial Sequence
  Description of Artificial Sequence: Synthetic oligonucleotide
accauguuuugcccauugacuauuacu

SEQ ID NO: 4569 - RNA, 27 nt, Artificial Sequence
  Description of Artificial Sequence: Synthetic oligonucleotide
cauguuuugcccauugacuauuacuuu

SEQ ID NO: 4570 - RNA, 27 nt, Artificial Sequence
  Description of Artificial Sequence: Synthetic oligonucleotide
cuguggagaugaagcuucuggguguca

SEQ ID NO: 4571 - RNA, 27 nt, Artificial Sequence
  Description of Artificial Sequence: Synthetic oligonucleotide
ugaagggaaacagaaguaccugugcgc

SEQ ID NO: 4572 - RNA, 27 nt, Artificial Sequence
  Description of Artificial Sequence: Synthetic oligonucleotide
gcagaaaugauugcacuauugauaaau

SEQ ID NO: 4573 - RNA, 27 nt, Artificial Sequence
  Description of Artificial Sequence: Synthetic oligonucleotide
cagaaaugauugcacuauugauaaauu

SEQ ID NO: 4574 - RNA, 27 nt, Artificial Sequence
  Description of Artificial Sequence: Synthetic oligonucleotide
agaaaugauugcacuauugauaaauuc

SEQ ID NO: 4575 - RNA, 27 nt, Artificial Sequence
  Description of Artificial Sequence: Synthetic oligonucleotide
aaaugauugcacuauugauaaauuccg

SEQ ID NO: 4576 - RNA, 27 nt, Artificial Sequence
  Description of Artificial Sequence: Synthetic oligonucleotide
aaugauugcacuauugauaaauuccga

SEQ ID NO: 4577 - RNA, 27 nt, Artificial Sequence
  Description of Artificial Sequence: Synthetic oligonucleotide
cacuauugauaaauuccgaaggaaaaa

SEQ ID NO: 4578 - RNA, 27 nt, Artificial Sequence
  Description of Artificial Sequence: Synthetic oligonucleotide
acuauugauaaauuccgaaggaaaaau

SEQ ID NO: 4579 - RNA, 27 nt, Artificial Sequence
  Description of Artificial Sequence: Synthetic oligonucleotide
cuauugauaaauuccgaaggaaaaauu

SEQ ID NO: 4580 - RNA, 27 nt, Artificial Sequence
  Description of Artificial Sequence: Synthetic oligonucleotide
uauugauaaauuccgaaggaaaaauug

SEQ ID NO: 4581 - RNA, 27 nt, Artificial Sequence
  Description of Artificial Sequence: Synthetic oligonucleotide
auugauaaauuccgaaggaaaaauugu

SEQ ID NO: 4582 - RNA, 27 nt, Artificial Sequence
  Description of Artificial Sequence: Synthetic oligonucleotide
ugauaaauuccgaaggaaaaauugucc

SEQ ID NO: 4583 - RNA, 27 nt, Artificial Sequence
  Description of Artificial Sequence: Synthetic oligonucleotide
gauaaauuccgaaggaaaaauugucca

SEQ ID NO: 4584 - RNA, 27 nt, Artificial Sequence
  Description of Artificial Sequence: Synthetic oligonucleotide
cgaaggaaaaauuguccaucuugucgu

SEQ ID NO: 4585 - RNA, 27 nt, Artificial Sequence
  Description of Artificial Sequence: Synthetic oligonucleotide
aucuugucgucuucggaaauguuauga

SEQ ID NO: 4586 - RNA, 27 nt, Artificial Sequence
  Description of Artificial Sequence: Synthetic oligonucleotide
cggaaauguuaugaagcagggaugacu

SEQ ID NO: 4587 - RNA, 27 nt, Artificial Sequence
  Description of Artificial Sequence: Synthetic oligonucleotide
gaaauguuaugaagcagggaugacucu

SEQ ID NO: 4588 - RNA, 27 nt, Artificial Sequence
  Description of Artificial Sequence: Synthetic oligonucleotide
cccggaagcugaagaaacuugguaauc

SEQ ID NO: 4589 - RNA, 27 nt, Artificial Sequence
  Description of Artificial Sequence: Synthetic oligonucleotide
cggaagcugaagaaacuugguaaucug

SEQ ID NO: 4590 - RNA, 27 nt, Artificial Sequence
  Description of Artificial Sequence: Synthetic oligonucleotide
gcugaagaaacuugguaaucugaaacu

SEQ ID NO: 4591 - RNA, 27 nt, Artificial Sequence
  Description of Artificial Sequence: Synthetic oligonucleotide
cugaagaaacuugguaaucugaaacua

SEQ ID NO: 4592 - RNA, 27 nt, Artificial Sequence
  Description of Artificial Sequence: Synthetic oligonucleotide
ugaagaaacuugguaaucugaaacuac

SEQ ID NO: 4593 - RNA, 27 nt, Artificial Sequence
  Description of Artificial Sequence: Synthetic oligonucleotide
uugguaaucugaaacuacaggaggaag

SEQ ID NO: 4594 - RNA, 27 nt, Artificial Sequence
  Description of Artificial Sequence: Synthetic oligonucleotide
aucugaaacuacaggaggaaggagagg

SEQ ID NO: 4595 - RNA, 27 nt, Artificial Sequence
  Description of Artificial Sequence: Synthetic oligonucleotide
cccaggaauuccugugcaugaaagcac

SEQ ID NO: 4596 - RNA, 27 nt, Artificial Sequence
  Description of Artificial Sequence: Synthetic oligonucleotide
ccaggaauuccugugcaugaaagcacu

SEQ ID NO: 4597 - RNA, 27 nt, Artificial Sequence
  Description of Artificial Sequence: Synthetic oligonucleotide
guggaugggcugaaaaaucaaaaauuc

SEQ ID NO: 4598 - RNA, 27 nt, Artificial Sequence
  Description of Artificial Sequence: Synthetic oligonucleotide
uggaugggcugaaaaaucaaaaauucu

SEQ ID NO: 4599 - RNA, 27 nt, Artificial Sequence
  Description of Artificial Sequence: Synthetic oligonucleotide
gaugggcugaaaaaucaaaaauucuuu

SEQ ID NO: 4600 - RNA, 27 nt, Artificial Sequence
  Description of Artificial Sequence: Synthetic oligonucleotide
ggcugaaaaaucaaaaauucuuugaug

SEQ ID NO: 4601 - RNA, 27 nt, Artificial Sequence
  Description of Artificial Sequence: Synthetic oligonucleotide
gcugaaaaaucaaaaauucuuugauga

SEQ ID NO: 4602 - RNA, 27 nt, Artificial Sequence
  Description of Artificial Sequence: Synthetic oligonucleotide
ugaaaaaucaaaaauucuuugaugaac

SEQ ID NO: 4603 - RNA, 27 nt, Artificial Sequence
  Description of Artificial Sequence: Synthetic oligonucleotide
gaaaaaucaaaaauucuuugaugaacu

SEQ ID NO: 4604 - RNA, 27 nt, Artificial Sequence
  Description of Artificial Sequence: Synthetic oligonucleotide
aaaaaucaaaaauucuuugaugaacuu

SEQ ID NO: 4605 - RNA, 27 nt, Artificial Sequence
  Description of Artificial Sequence: Synthetic oligonucleotide
uucgaaugaacuacaucaaggaacucg

SEQ ID NO: 4606 - RNA, 27 nt, Artificial Sequence
  Description of Artificial Sequence: Synthetic oligonucleotide
ucaaggaacucgaucguaucauugcau

SEQ ID NO: 4607 - RNA, 27 nt, Artificial Sequence
  Description of Artificial Sequence: Synthetic oligonucleotide
caaggaacucgaucguaucauugcaug

SEQ ID NO: 4608 - RNA, 27 nt, Artificial Sequence
  Description of Artificial Sequence: Synthetic oligonucleotide
aucguaucauugcaugcaaaagaaaaa

SEQ ID NO: 4609 - RNA, 27 nt, Artificial Sequence
  Description of Artificial Sequence: Synthetic oligonucleotide
ucguaucauugcaugcaaaagaaaaaa

SEQ ID NO: 4610 - RNA, 27 nt, Artificial Sequence
  Description of Artificial Sequence: Synthetic oligonucleotide
aucauugcaugcaaaagaaaaaauccc

SEQ ID NO: 4611 - RNA, 27 nt, Artificial Sequence
  Description of Artificial Sequence: Synthetic oligonucleotide
cacuuuugaccugcuaaucaagucaca

SEQ ID NO: 4612 - RNA, 27 nt, Artificial Sequence
  Description of Artificial Sequence: Synthetic oligonucleotide
gcguggacuuuccggaaaugauggcag

SEQ ID NO: 4613 - RNA, 27 nt, Artificial Sequence
  Description of Artificial Sequence: Synthetic oligonucleotide
cguggacuuuccggaaaugauggcaga

SEQ ID NO: 4614 - RNA, 27 nt, Artificial Sequence
  Description of Artificial Sequence: Synthetic oligonucleotide
ugauggcagagaucaucucugugcaag

SEQ ID NO: 4615 - RNA, 27 nt, Artificial Sequence
  Description of Artificial Sequence: Synthetic oligonucleotide
gcagagaucaucucugugcaagugccc

SEQ ID NO: 4616 - RNA, 27 nt, Artificial Sequence
  Description of Artificial Sequence: Synthetic oligonucleotide
cagagaucaucucugugcaagugccca

SEQ ID NO: 4617 - RNA, 27 nt, Artificial Sequence
  Description of Artificial Sequence: Synthetic oligonucleotide
cccaagauccuuucugggaaagucaag

SEQ ID NO: 4618 - RNA, 27 nt, Artificial Sequence
  Description of Artificial Sequence: Synthetic oligonucleotide
gugaagcauuggaaacccuauuucccc

SEQ ID NO: 4619 - RNA, 27 nt, Artificial Sequence
  Description of Artificial Sequence: Synthetic oligonucleotide
cagaugucuucugccuguuauaacucu

SEQ ID NO: 4620 - RNA, 27 nt, Artificial Sequence
  Description of Artificial Sequence: Synthetic oligonucleotide
gccuuggggaauuuccucuauugaugu

SEQ ID NO: 4621 - RNA, 27 nt, Artificial Sequence
  Description of Artificial Sequence: Synthetic oligonucleotide
cuuggggaauuuccucuauugauguac

SEQ ID NO: 4622 - RNA, 27 nt, Artificial Sequence
  Description of Artificial Sequence: Synthetic oligonucleotide
uuggggaauuuccucuauugauguaca

SEQ ID NO: 4623 - RNA, 27 nt, Artificial Sequence
  Description of Artificial Sequence: Synthetic oligonucleotide
uggggaauuuccucuauugauguacag

SEQ ID NO: 4624 - RNA, 27 nt, Artificial Sequence
  Description of Artificial Sequence: Synthetic oligonucleotide
ggggaauuuccucuauugauguacagu

SEQ ID NO: 4625 - RNA, 27 nt, Artificial Sequence
  Description of Artificial Sequence: Synthetic oligonucleotide
cuauugauguacagucugucaugaaca

SEQ ID NO: 4626 - RNA, 27 nt, Artificial Sequence
  Description of Artificial Sequence: Synthetic oligonucleotide
uauugauguacagucugucaugaacau

SEQ ID NO: 4627 - RNA, 27 nt, Artificial Sequence
  Description of Artificial Sequence: Synthetic oligonucleotide
auugauguacagucugucaugaacaug

SEQ ID NO: 4628 - RNA, 27 nt, Artificial Sequence
  Description of Artificial Sequence: Synthetic oligonucleotide
aacauguuccugaauucuauuugcugg

SEQ ID NO: 4629 - RNA, 27 nt, Artificial Sequence
  Description of Artificial Sequence: Synthetic oligonucleotide
uucuauuugcugggcuuuuuuuuucuc

SEQ ID NO: 4630 - RNA, 27 nt, Artificial Sequence
  Description of Artificial Sequence: Synthetic oligonucleotide
ucuauuugcugggcuuuuuuuuucucu

SEQ ID NO: 4631 - RNA, 27 nt, Artificial Sequence
  Description of Artificial Sequence: Synthetic oligonucleotide
ugcugggcuuuuuuuuucucuuucucu

SEQ ID NO: 4632 - RNA, 27 nt, Artificial Sequence
  Description of Artificial Sequence: Synthetic oligonucleotide
uuuuuuuucucuuucucuccuuucuuu

SEQ ID NO: 4633 - RNA, 27 nt, Artificial Sequence
  Description of Artificial Sequence: Synthetic oligonucleotide
uucagacuuugcuucccauuguggcuc

SEQ ID NO: 4634 - RNA, 27 nt, Artificial Sequence
  Description of Artificial Sequence: Synthetic oligonucleotide
uuguggcuccuaucuguguuuugaaug

SEQ ID NO: 4635 - RNA, 27 nt, Artificial Sequence
  Description of Artificial Sequence: Synthetic oligonucleotide
uccuaucuguguuuugaaugguguugu

SEQ ID NO: 4636 - RNA, 27 nt, Artificial Sequence
  Description of Artificial Sequence: Synthetic oligonucleotide
aucuguguuuugaaugguguuguaugc

SEQ ID NO: 4637 - RNA, 27 nt, Artificial Sequence
  Description of Artificial Sequence: Synthetic oligonucleotide
uguguuuugaaugguguuguaugccuu

SEQ ID NO: 4638 - RNA, 27 nt, Artificial Sequence
  Description of Artificial Sequence: Synthetic oligonucleotide
ugaaugguguuguaugccuuuaaaucu

SEQ ID NO: 4639 - RNA, 27 nt, Artificial Sequence
  Description of Artificial Sequence: Synthetic oligonucleotide
gaaugguguuguaugccuuuaaaucug

SEQ ID NO: 4640 - RNA, 27 nt, Artificial Sequence
  Description of Artificial Sequence: Synthetic oligonucleotide
uguuguaugccuuuaaaucugugauga

SEQ ID NO: 4641 - RNA, 27 nt, Artificial Sequence
  Description of Artificial Sequence: Synthetic oligonucleotide
uuguaugccuuuaaaucugugaugauc

SEQ ID NO: 4642 - RNA, 27 nt, Artificial Sequence
  Description of Artificial Sequence: Synthetic oligonucleotide
uguaugccuuuaaaucugugaugaucc

SEQ ID NO: 4643 - RNA, 27 nt, Artificial Sequence
  Description of Artificial Sequence: Synthetic oligonucleotide
cccagugucaaguugugcuuguuuaca

SEQ ID NO: 4644 - RNA, 27 nt, Artificial Sequence
  Description of Artificial Sequence: Synthetic oligonucleotide
ccagugucaaguugugcuuguuuacag

SEQ ID NO: 4645 - RNA, 27 nt, Artificial Sequence
  Description of Artificial Sequence: Synthetic oligonucleotide
gcuuguuuacagcacuacucugugcca

SEQ ID NO: 4646 - RNA, 27 nt, Artificial Sequence
  Description of Artificial Sequence: Synthetic oligonucleotide
cuuguuuacagcacuacucugugccag

SEQ ID NO: 4647 - RNA, 27 nt, Artificial Sequence
  Description of Artificial Sequence: Synthetic oligonucleotide
cacaaacguuuacuuaucuuaugccac

SEQ ID NO: 4648 - RNA, 27 nt, Artificial Sequence
  Description of Artificial Sequence: Synthetic oligonucleotide
cacgggaaguuuagagagcuaagauua

SEQ ID NO: 4649 - RNA, 27 nt, Artificial Sequence
  Description of Artificial Sequence: Synthetic oligonucleotide
acgggaaguuuagagagcuaagauuau

SEQ ID NO: 4650 - RNA, 27 nt, Artificial Sequence
  Description of Artificial Sequence: Synthetic oligonucleotide
cgggaaguuuagagagcuaagauuauc

SEQ ID NO: 4651 - RNA, 27 nt, Artificial Sequence
  Description of Artificial Sequence: Synthetic oligonucleotide
gggaaguuuagagagcuaagauuaucu

SEQ ID NO: 4652 - RNA, 27 nt, Artificial Sequence
  Description of Artificial Sequence: Synthetic oligonucleotide
gaaguuuagagagcuaagauuaucugg

SEQ ID NO: 4653 - RNA, 27 nt, Artificial Sequence
  Description of Artificial Sequence: Synthetic oligonucleotide
uuagagagcuaagauuaucuggggaaa

SEQ ID NO: 4654 - RNA, 27 nt, Artificial Sequence
  Description of Artificial Sequence: Synthetic oligonucleotide
uagagagcuaagauuaucuggggaaau

SEQ ID NO: 4655 - RNA, 27 nt, Artificial Sequence
  Description of Artificial Sequence: Synthetic oligonucleotide
agagagcuaagauuaucuggggaaauc

SEQ ID NO: 4656 - RNA, 27 nt, Artificial Sequence
  Description of Artificial Sequence: Synthetic oligonucleotide
uaagauuaucuggggaaaucaaaacaa

SEQ ID NO: 4657 - RNA, 27 nt, Artificial Sequence
  Description of Artificial Sequence: Synthetic oligonucleotide
aagauuaucuggggaaaucaaaacaaa

SEQ ID NO: 4658 - RNA, 27 nt, Artificial Sequence
  Description of Artificial Sequence: Synthetic oligonucleotide
aucuggggaaaucaaaacaaaaacaag

SEQ ID NO: 4659 - RNA, 27 nt, Artificial Sequence
  Description of Artificial Sequence: Synthetic oligonucleotide
ggggaaaucaaaacaaaaacaagcaaa

SEQ ID NO: 4660 - RNA, 27 nt, Artificial Sequence
  Description of Artificial Sequence: Synthetic oligonucleotide
gugaaguuuuuaaaagcugcuaaagac

SEQ ID NO: 4661 - RNA, 27 nt, Artificial Sequence
  Description of Artificial Sequence: Synthetic oligonucleotide
agcuagcugcacauugcaaagaaggcu

SEQ ID NO: 4662 - RNA, 27 nt, Artificial Sequence
  Description of Artificial Sequence: Synthetic oligonucleotide
acauugcaaagaaggcucuuaggagcc

SEQ ID NO: 4663 - RNA, 27 nt, Artificial Sequence
  Description of Artificial Sequence: Synthetic oligonucleotide
aacaaaacaaacaaaaacaaaaaagcc

SEQ ID NO: 4664 - RNA, 27 nt, Artificial Sequence
  Description of Artificial Sequence: Synthetic oligonucleotide
aagauaauaacucaguucuuauuugca

SEQ ID NO: 4665 - RNA, 27 nt, Artificial Sequence
  Description of Artificial Sequence: Synthetic oligonucleotide
uucaguggacacugaauuuggaaggug

SEQ ID NO: 4666 - RNA, 27 nt, Artificial Sequence
  Description of Artificial Sequence: Synthetic oligonucleotide
caguggacacugaauuuggaaggugga

SEQ ID NO: 4667 - RNA, 27 nt, Artificial Sequence
  Description of Artificial Sequence: Synthetic oligonucleotide
aguggacacugaauuuggaagguggag

SEQ ID NO: 4668 - RNA, 27 nt, Artificial Sequence
  Description of Artificial Sequence: Synthetic oligonucleotide
uugaaucuacccuucaaguauuaagag

SEQ ID NO: 4669 - RNA, 27 nt, Artificial Sequence
  Description of Artificial Sequence: Synthetic oligonucleotide
caaguauuaagagacagacugugagcc

SEQ ID NO: 4670 - RNA, 27 nt, Artificial Sequence
  Description of Artificial Sequence: Synthetic oligonucleotide
gcugaguauuccccuuucaagggaggu

SEQ ID NO: 4671 - RNA, 27 nt, Artificial Sequence
  Description of Artificial Sequence: Synthetic oligonucleotide
cugaguauuccccuuucaagggagguu

SEQ ID NO: 4672 - RNA, 27 nt, Artificial Sequence
  Description of Artificial Sequence: Synthetic oligonucleotide
ucuguggagaugaagcuucuggguguc

SEQ ID NO: 4673 - RNA, 27 nt, Artificial Sequence
  Description of Artificial Sequence: Synthetic oligonucleotide
gaagggaaacagaaguaccugugcgcc

SEQ ID NO: 4674 - RNA, 27 nt, Artificial Sequence
  Description of Artificial Sequence: Synthetic oligonucleotide
uugauaaauuccgaaggaaaaauuguc

SEQ ID NO: 4675 - RNA, 27 nt, Artificial Sequence
  Description of Artificial Sequence: Synthetic oligonucleotide
gaaggaaaaauuguccaucuugucguc

SEQ ID NO: 4676 - RNA, 27 nt, Artificial Sequence
  Description of Artificial Sequence: Synthetic oligonucleotide
ucggaaauguuaugaagcagggaugac

SEQ ID NO: 4677 - RNA, 27 nt, Artificial Sequence
  Description of Artificial Sequence: Synthetic oligonucleotide
acuugguaaucugaaacuacaggagga

SEQ ID NO: 4678 - RNA, 27 nt, Artificial Sequence
  Description of Artificial Sequence: Synthetic oligonucleotide
cuugguaaucugaaacuacaggaggaa

SEQ ID NO: 4679 - RNA, 27 nt, Artificial Sequence
  Description of Artificial Sequence: Synthetic oligonucleotide
gguaaucugaaacuacaggaggaagga

SEQ ID NO: 4680 - RNA, 27 nt, Artificial Sequence
  Description of Artificial Sequence: Synthetic oligonucleotide
agcugacagugucacacauugaaggcu

SEQ ID NO: 4681 - RNA, 27 nt, Artificial Sequence
  Description of Artificial Sequence: Synthetic oligonucleotide
ggcugucauucaguacuccuggauggg

SEQ ID NO: 4682 - RNA, 27 nt, Artificial Sequence
  Description of Artificial Sequence: Synthetic oligonucleotide
cugaaaaaucaaaaauucuuugaugaa

SEQ ID NO: 4683 - RNA, 27 nt, Artificial Sequence
  Description of Artificial Sequence: Synthetic oligonucleotide
aaaauucuuugaugaacuucgaaugaa

SEQ ID NO: 4684 - RNA, 27 nt, Artificial Sequence
  Description of Artificial Sequence: Synthetic oligonucleotide
ugcuaaucaagucacacauggugagcg

SEQ ID NO: 4685 - RNA, 27 nt, Artificial Sequence
  Description of Artificial Sequence: Synthetic oligonucleotide
agcguggacuuuccggaaaugauggca

SEQ ID NO: 4686 - RNA, 27 nt, Artificial Sequence
  Description of Artificial Sequence: Synthetic oligonucleotide
ccuuggggaauuuccucuauugaugua

SEQ ID NO: 4687 - RNA, 27 nt, Artificial Sequence
  Description of Artificial Sequence: Synthetic oligonucleotide
ucuguguuuugaaugguguuguaugcc

SEQ ID NO: 4688 - RNA, 27 nt, Artificial Sequence
  Description of Artificial Sequence: Synthetic oligonucleotide
guuguaugccuuuaaaucugugaugau

SEQ ID NO: 4689 - RNA, 27 nt, Artificial Sequence
  Description of Artificial Sequence: Synthetic oligonucleotide
uuuagagagcuaagauuaucuggggaa

SEQ ID NO: 4690 - RNA, 27 nt, Artificial Sequence
  Description of Artificial Sequence: Synthetic oligonucleotide
ucggugaaguuuuuaaaagcugcuaaa

SEQ ID NO: 4691 - RNA, 27 nt, Artificial Sequence
  Description of Artificial Sequence: Synthetic oligonucleotide
aguuuuuaaaagcugcuaaagacucgg

SEQ ID NO: 4692 - RNA, 27 nt, Artificial Sequence
  Description of Artificial Sequence: Synthetic oligonucleotide
gcagagagguaacucccuuuggcugcg

SEQ ID NO: 4693 - RNA, 27 nt, Artificial Sequence
  Description of Artificial Sequence: Synthetic oligonucleotide
cagagaucaaaagaugaaaaggcaguc

SEQ ID NO: 4694 - RNA, 27 nt, Artificial Sequence
  Description of Artificial Sequence: Synthetic oligonucleotide
caaaaaacaaaacaaacaaaaacaaaa

SEQ ID NO: 4695 - RNA, 27 nt, Artificial Sequence
  Description of Artificial Sequence: Synthetic oligonucleotide
aaauaaaagaaaaagauaauaacucag

SEQ ID NO: 4696 - RNA, 27 nt, Artificial Sequence
  Description of Artificial Sequence: Synthetic oligonucleotide
agaaaaagauaauaacucaguucuuau

SEQ ID NO: 4697 - RNA, 27 nt, Artificial Sequence
  Description of Artificial Sequence: Synthetic oligonucleotide
auaauaacucaguucuuauuugcaccu

SEQ ID NO: 4698 - RNA, 27 nt, Artificial Sequence
  Description of Artificial Sequence: Synthetic oligonucleotide
agguggaggauuuuguuuuuuucuuuu

SEQ ID NO: 4699 - RNA, 27 nt, Artificial Sequence
  Description of Artificial Sequence: Synthetic oligonucleotide
uuuuguuuuuuucuuuuaagaucuggg

SEQ ID NO: 4700 - RNA, 27 nt, Artificial Sequence
  Description of Artificial Sequence: Synthetic oligonucleotide
uuuuuuucuuuuaagaucugggcaucu

SEQ ID NO: 4701 - RNA, 27 nt, Artificial Sequence
  Description of Artificial Sequence: Synthetic oligonucleotide
aucugggcaucuuuugaaucuacccuu

SEQ ID NO: 4702 - RNA, 27 nt, Artificial Sequence
  Description of Artificial Sequence: Synthetic oligonucleotide
uaagggaaguagguggaagauucagcc

SEQ ID NO: 4703 - RNA, 27 nt, Artificial Sequence
  Description of Artificial Sequence: Synthetic oligonucleotide
gaggagcuuuccagaaucuguuccaga

SEQ ID NO: 4704 - RNA, 27 nt, Artificial Sequence
  Description of Artificial Sequence: Synthetic oligonucleotide
agcaggaagcaguauccgaaggcagca

SEQ ID NO: 4705 - RNA, 27 nt, Artificial Sequence
  Description of Artificial Sequence: Synthetic oligonucleotide
ccaaggacaauuacuuagggggcacuu

SEQ ID NO: 4706 - RNA, 27 nt, Artificial Sequence
  Description of Artificial Sequence: Synthetic oligonucleotide
aaggaguuguguaaggcagugucggug

SEQ ID NO: 4707 - RNA, 27 nt, Artificial Sequence
  Description of Artificial Sequence: Synthetic oligonucleotide
ggcaagagcacugaagauacugcugag

SEQ ID NO: 4708 - RNA, 27 nt, Artificial Sequence
  Description of Artificial Sequence: Synthetic oligonucleotide
acugaagauacugcugaguauuccccu

SEQ ID NO: 4709 - RNA, 27 nt, Artificial Sequence
  Description of Artificial Sequence: Synthetic oligonucleotide
caagggagguuacaccaaagggcuaga

SEQ ID NO: 4710 - RNA, 27 nt, Artificial Sequence
  Description of Artificial Sequence: Synthetic oligonucleotide
cuugugucaaaagcgaaaugggccccu

SEQ ID NO: 4711 - RNA, 27 nt, Artificial Sequence
  Description of Artificial Sequence: Synthetic oligonucleotide
auguuuugcccauugacuauuacuuuc

SEQ ID NO: 4712 - RNA, 27 nt, Artificial Sequence
  Description of Artificial Sequence: Synthetic oligonucleotide
ugcaaggucuucuucaaaagagccgcu

SEQ ID NO: 4713 - RNA, 27 nt, Artificial Sequence
  Description of Artificial Sequence: Synthetic oligonucleotide
aagggaaacagaaguaccugugcgcca

SEQ ID NO: 4714 - RNA, 27 nt, Artificial Sequence
  Description of Artificial Sequence: Synthetic oligonucleotide
augauugcacuauugauaaauuccgaa

SEQ ID NO: 4715 - RNA, 27 nt, Artificial Sequence
  Description of Artificial Sequence: Synthetic oligonucleotide
uaaauuccgaaggaaaaauuguccauc

SEQ ID NO: 4716 - RNA, 27 nt, Artificial Sequence
  Description of Artificial Sequence: Synthetic oligonucleotide
aaggaaaaauuguccaucuugucgucu

SEQ ID NO: 4717 - RNA, 27 nt, Artificial Sequence
  Description of Artificial Sequence: Synthetic oligonucleotide
gaaaaauuguccaucuugucgucuucg

SEQ ID NO: 4718 - RNA, 27 nt, Artificial Sequence
  Description of Artificial Sequence: Synthetic oligonucleotide
gaagaaacuugguaaucugaaacuaca

SEQ ID NO: 4719 - RNA, 27 nt, Artificial Sequence
  Description of Artificial Sequence: Synthetic oligonucleotide
cauugaaggcuaugaaugucagcccau

SEQ ID NO: 4720 - RNA, 27 nt, Artificial Sequence
  Description of Artificial Sequence: Synthetic oligonucleotide
caggaauuccugugcaugaaagcacug

SEQ ID NO: 4721 - RNA, 27 nt, Artificial Sequence
  Description of Artificial Sequence: Synthetic oligonucleotide
ucaaaaauucuuugaugaacuucgaau

SEQ ID NO: 4722 - RNA, 27 nt, Artificial Sequence
  Description of Artificial Sequence: Synthetic oligonucleotide
ucuuugaugaacuucgaaugaacuaca

SEQ ID NO: 4723 - RNA, 27 nt, Artificial Sequence
  Description of Artificial Sequence: Synthetic oligonucleotide
uugaugaacuucgaaugaacuacauca

SEQ ID NO: 4724 - RNA, 27 nt, Artificial Sequence
  Description of Artificial Sequence: Synthetic oligonucleotide
ucgaaugaacuacaucaaggaacucga

SEQ ID NO: 4725 - RNA, 27 nt, Artificial Sequence
  Description of Artificial Sequence: Synthetic oligonucleotide
ugcaaaagaaaaaaucccacauccugc

SEQ ID NO: 4726 - RNA, 27 nt, Artificial Sequence
  Description of Artificial Sequence: Synthetic oligonucleotide
aaagaaaaaaucccacauccugcucaa

SEQ ID NO: 4727 - RNA, 27 nt, Artificial Sequence
  Description of Artificial Sequence: Synthetic oligonucleotide
acuuuugaccugcuaaucaagucacac

SEQ ID NO: 4728 - RNA, 27 nt, Artificial Sequence
  Description of Artificial Sequence: Synthetic oligonucleotide
ccaagauccuuucugggaaagucaagc

SEQ ID NO: 4729 - RNA, 27 nt, Artificial Sequence
  Description of Artificial Sequence: Synthetic oligonucleotide
ggaaagucaagcccaucuauuuccaca

SEQ ID NO: 4730 - RNA, 27 nt, Artificial Sequence
  Description of Artificial Sequence: Synthetic oligonucleotide
agaugucuucugccuguuauaacucug

SEQ ID NO: 4731 - RNA, 27 nt, Artificial Sequence
  Description of Artificial Sequence: Synthetic oligonucleotide
gggaauuuccucuauugauguacaguc

SEQ ID NO: 4732 - RNA, 27 nt, Artificial Sequence
  Description of Artificial Sequence: Synthetic oligonucleotide
uugauguacagucugucaugaacaugu

SEQ ID NO: 4733 - RNA, 27 nt, Artificial Sequence
  Description of Artificial Sequence: Synthetic oligonucleotide
uacagucugucaugaacauguuccuga

SEQ ID NO: 4734 - RNA, 27 nt, Artificial Sequence
  Description of Artificial Sequence: Synthetic oligonucleotide
gucaugaacauguuccugaauucuauu

SEQ ID NO: 4735 - RNA, 27 nt, Artificial Sequence
  Description of Artificial Sequence: Synthetic oligonucleotide
acauguuccugaauucuauuugcuggg

SEQ ID NO: 4736 - RNA, 27 nt, Artificial Sequence
  Description of Artificial Sequence: Synthetic oligonucleotide
gcugggcuuuuuuuuucucuuucucuc

SEQ ID NO: 4737 - RNA, 27 nt, Artificial Sequence
  Description of Artificial Sequence: Synthetic oligonucleotide
uuuuuuucucuuucucuccuuucuuuu

SEQ ID NO: 4738 - RNA, 27 nt, Artificial Sequence
  Description of Artificial Sequence: Synthetic oligonucleotide
guguuuugaaugguguuguaugccuuu

SEQ ID NO: 4739 - RNA, 27 nt, Artificial Sequence
  Description of Artificial Sequence: Synthetic oligonucleotide
augguguuguaugccuuuaaaucugug

SEQ ID NO: 4740 - RNA, 27 nt, Artificial Sequence
  Description of Artificial Sequence: Synthetic oligonucleotide
gucaaguugugcuuguuuacagcacua

SEQ ID NO: 4741 - RNA, 27 nt, Artificial Sequence
  Description of Artificial Sequence: Synthetic oligonucleotide
agcuaagauuaucuggggaaaucaaaa

SEQ ID NO: 4742 - RNA, 27 nt, Artificial Sequence
  Description of Artificial Sequence: Synthetic oligonucleotide
ucuggggaaaucaaaacaaaaacaagc

SEQ ID NO: 4743 - RNA, 27 nt, Artificial Sequence
  Description of Artificial Sequence: Synthetic oligonucleotide
gggaaaucaaaacaaaaacaagcaaac

SEQ ID NO: 4744 - RNA, 27 nt, Artificial Sequence
  Description of Artificial Sequence: Synthetic oligonucleotide
cggugaaguuuuuaaaagcugcuaaag

SEQ ID NO: 4745 - RNA, 27 nt, Artificial Sequence
  Description of Artificial Sequence: Synthetic oligonucleotide
guuuuuaaaagcugcuaaagacucgga

SEQ ID NO: 4746 - RNA, 27 nt, Artificial Sequence
  Description of Artificial Sequence: Synthetic oligonucleotide
uuuuaaaagcugcuaaagacucggagg

SEQ ID NO: 4747 - RNA, 27 nt, Artificial Sequence
  Description of Artificial Sequence: Synthetic oligonucleotide
gcggagagaacccucuguuuuccccca

SEQ ID NO: 4748 - RNA, 27 nt, Artificial Sequence
  Description of Artificial Sequence: Synthetic oligonucleotide
agagaucaaaagaugaaaaggcaguca

SEQ ID NO: 4749 - RNA, 27 nt, Artificial Sequence
  Description of Artificial Sequence: Synthetic oligonucleotide
aucaaaagaugaaaaggcagucagguc

SEQ ID NO: 4750 - RNA, 27 nt, Artificial Sequence
  Description of Artificial Sequence: Synthetic oligonucleotide
uucaguagccaaaaaacaaaacaaaca

SEQ ID NO: 4751 - RNA, 27 nt, Artificial Sequence
  Description of Artificial Sequence: Synthetic oligonucleotide
aaaaaacaaaacaaacaaaaacaaaaa

SEQ ID NO: 4752 - RNA, 27 nt, Artificial Sequence
  Description of Artificial Sequence: Synthetic oligonucleotide
aauaaaagaaaaagauaauaacucagu

SEQ ID NO: 4753 - RNA, 27 nt, Artificial Sequence
  Description of Artificial Sequence: Synthetic oligonucleotide
uaaaagaaaaagauaauaacucaguuc

SEQ ID NO: 4754 - RNA, 27 nt, Artificial Sequence
  Description of Artificial Sequence: Synthetic oligonucleotide
gaaaaagauaauaacucaguucuuauu

SEQ ID NO: 4755 - RNA, 27 nt, Artificial Sequence
  Description of Artificial Sequence: Synthetic oligonucleotide
uaauaacucaguucuuauuugcaccua

SEQ ID NO: 4756 - RNA, 27 nt, Artificial Sequence
  Description of Artificial Sequence: Synthetic oligonucleotide
cucaguucuuauuugcaccuacuucag

SEQ ID NO: 4757 - RNA, 27 nt, Artificial Sequence
  Description of Artificial Sequence: Synthetic oligonucleotide
gguggaggauuuuguuuuuuucuuuua

SEQ ID NO: 4758 - RNA, 27 nt, Artificial Sequence
  Description of Artificial Sequence: Synthetic oligonucleotide
uuuguuuuuuucuuuuaagaucugggc

SEQ ID NO: 4759 - RNA, 27 nt, Artificial Sequence
  Description of Artificial Sequence: Synthetic oligonucleotide
uuuuuucuuuuaagaucugggcaucuu

SEQ ID NO: 4760 - RNA, 27 nt, Artificial Sequence
  Description of Artificial Sequence: Synthetic oligonucleotide
ucugggcaucuuuugaaucuacccuuc

SEQ ID NO: 4761 - RNA, 27 nt, Artificial Sequence
  Description of Artificial Sequence: Synthetic oligonucleotide
cgcaaguuuccuucucuggagcuuccc

SEQ ID NO: 4762 - RNA, 27 nt, Artificial Sequence
  Description of Artificial Sequence: Synthetic oligonucleotide
aagggaaguagguggaagauucagcca

SEQ ID NO: 4763 - RNA, 27 nt, Artificial Sequence
  Description of Artificial Sequence: Synthetic oligonucleotide
ggaaguagguggaagauucagccaagc

SEQ ID NO: 4764 - RNA, 27 nt, Artificial Sequence
  Description of Artificial Sequence: Synthetic oligonucleotide
caaggacaauuacuuagggggcacuuc

SEQ ID NO: 4765 - RNA, 27 nt, Artificial Sequence
  Description of Artificial Sequence: Synthetic oligonucleotide
gccgaaugcaaagguucucugcuagac

SEQ ID NO: 4766 - RNA, 27 nt, Artificial Sequence
  Description of Artificial Sequence: Synthetic oligonucleotide
gcaagagcacugaagauacugcugagu

SEQ ID NO: 4767 - RNA, 27 nt, Artificial Sequence
  Description of Artificial Sequence: Synthetic oligonucleotide
cugaagauacugcugaguauuccccuu

SEQ ID NO: 4768 - RNA, 27 nt, Artificial Sequence
  Description of Artificial Sequence: Synthetic oligonucleotide
uugugucaaaagcgaaaugggccccug

SEQ ID NO: 4769 - RNA, 27 nt, Artificial Sequence
  Description of Artificial Sequence: Synthetic oligonucleotide
uguuuugcccauugacuauuacuuucc

SEQ ID NO: 4770 - RNA, 27 nt, Artificial Sequence
  Description of Artificial Sequence: Synthetic oligonucleotide
cccauugacuauuacuuuccaccccag

SEQ ID NO: 4771 - RNA, 27 nt, Artificial Sequence
  Description of Artificial Sequence: Synthetic oligonucleotide
gcaaggucuucuucaaaagagccgcug

SEQ ID NO: 4772 - RNA, 27 nt, Artificial Sequence
  Description of Artificial Sequence: Synthetic oligonucleotide
ugauugcacuauugauaaauuccgaag

SEQ ID NO: 4773 - RNA, 27 nt, Artificial Sequence
  Description of Artificial Sequence: Synthetic oligonucleotide
uccgaaggaaaaauuguccaucuuguc

SEQ ID NO: 4774 - RNA, 27 nt, Artificial Sequence
  Description of Artificial Sequence: Synthetic oligonucleotide
aggaaaaauuguccaucuugucgucuu

SEQ ID NO: 4775 - RNA, 27 nt, Artificial Sequence
  Description of Artificial Sequence: Synthetic oligonucleotide
gacagugucacacauugaaggcuauga

SEQ ID NO: 4776 - RNA, 27 nt, Artificial Sequence
  Description of Artificial Sequence: Synthetic oligonucleotide
auugaaggcuaugaaugucagcccauc

SEQ ID NO: 4777 - RNA, 27 nt, Artificial Sequence
  Description of Artificial Sequence: Synthetic oligonucleotide
agauggcugucauucaguacuccugga

SEQ ID NO: 4778 - RNA, 27 nt, Artificial Sequence
  Description of Artificial Sequence: Synthetic oligonucleotide
ucugguuuucaaugaguaccgcaugca

SEQ ID NO: 4779 - RNA, 27 nt, Artificial Sequence
  Description of Artificial Sequence: Synthetic oligonucleotide
aggaauuccugugcaugaaagcacugc

SEQ ID NO: 4780 - RNA, 27 nt, Artificial Sequence
  Description of Artificial Sequence: Synthetic oligonucleotide
caaaaauucuuugaugaacuucgaaug

SEQ ID NO: 4781 - RNA, 27 nt, Artificial Sequence
  Description of Artificial Sequence: Synthetic oligonucleotide
cuuugaugaacuucgaaugaacuacau

SEQ ID NO: 4782 - RNA, 27 nt, Artificial Sequence
  Description of Artificial Sequence: Synthetic oligonucleotide
ugaugaacuucgaaugaacuacaucaa

SEQ ID NO: 4783 - RNA, 27 nt, Artificial Sequence
  Description of Artificial Sequence: Synthetic oligonucleotide
cgaaugaacuacaucaaggaacucgau

SEQ ID NO: 4784 - RNA, 27 nt, Artificial Sequence
  Description of Artificial Sequence: Synthetic oligonucleotide
aaugaacuacaucaaggaacucgaucg

SEQ ID NO: 4785 - RNA, 27 nt, Artificial Sequence
  Description of Artificial Sequence: Synthetic oligonucleotide
gcaaaagaaaaaaucccacauccugcu

SEQ ID NO: 4786 - RNA, 27 nt, Artificial Sequence
  Description of Artificial Sequence: Synthetic oligonucleotide
aagaaaaaaucccacauccugcucaag

SEQ ID NO: 4787 - RNA, 27 nt, Artificial Sequence
  Description of Artificial Sequence: Synthetic oligonucleotide
cuuuugaccugcuaaucaagucacaca

SEQ ID NO: 4788 - RNA, 27 nt, Artificial Sequence
  Description of Artificial Sequence: Synthetic oligonucleotide
gccuguuauaacucugcacuacuccuc

SEQ ID NO: 4789 - RNA, 27 nt, Artificial Sequence
  Description of Artificial Sequence: Synthetic oligonucleotide
cuguuauaacucugcacuacuccucug

SEQ ID NO: 4790 - RNA, 27 nt, Artificial Sequence
  Description of Artificial Sequence: Synthetic oligonucleotide
ggaauuuccucuauugauguacagucu

SEQ ID NO: 4791 - RNA, 27 nt, Artificial Sequence
  Description of Artificial Sequence: Synthetic oligonucleotide
cucuauugauguacagucugucaugaa

SEQ ID NO: 4792 - RNA, 27 nt, Artificial Sequence
  Description of Artificial Sequence: Synthetic oligonucleotide
ucaugaacauguuccugaauucuauuu

SEQ ID NO: 4793 - RNA, 27 nt, Artificial Sequence
  Description of Artificial Sequence: Synthetic oligonucleotide
uccugaauucuauuugcugggcuuuuu

SEQ ID NO: 4794 - RNA, 27 nt, Artificial Sequence
  Description of Artificial Sequence: Synthetic oligonucleotide
gcuuuuuuuuucucuuucucuccuuuc

SEQ ID NO: 4795 - RNA, 27 nt, Artificial Sequence
  Description of Artificial Sequence: Synthetic oligonucleotide
uuuuuucucuuucucuccuuucuuuuu

SEQ ID NO: 4796 - RNA, 27 nt, Artificial Sequence
  Description of Artificial Sequence: Synthetic oligonucleotide
cucuuucucuccuuucuuuuucuucuu

SEQ ID NO: 4797 - RNA, 27 nt, Artificial Sequence
  Description of Artificial Sequence: Synthetic oligonucleotide
ccauggcaccuucagacuuugcuuccc

SEQ ID NO: 4798 - RNA, 27 nt, Artificial Sequence
  Description of Artificial Sequence: Synthetic oligonucleotide
uguuuugaaugguguuguaugccuuua

SEQ ID NO: 4799 - RNA, 27 nt, Artificial Sequence
  Description of Artificial Sequence: Synthetic oligonucleotide
ugguguuguaugccuuuaaaucuguga

SEQ ID NO: 4800 - RNA, 27 nt, Artificial Sequence
  Description of Artificial Sequence: Synthetic oligonucleotide
cuuuaaaucugugaugauccucauaug

SEQ ID NO: 4801 - RNA, 27 nt, Artificial Sequence
  Description of Artificial Sequence: Synthetic oligonucleotide
ucugugaugauccucauauggcccagu

SEQ ID NO: 4802 - RNA, 27 nt, Artificial Sequence
  Description of Artificial Sequence: Synthetic oligonucleotide
aaguugugcuuguuuacagcacuacuc

SEQ ID NO: 4803 - RNA, 27 nt, Artificial Sequence
  Description of Artificial Sequence: Synthetic oligonucleotide
acguuuacuuaucuuaugccacgggaa

SEQ ID NO: 4804 - RNA, 27 nt, Artificial Sequence
  Description of Artificial Sequence: Synthetic oligonucleotide
aguuuagagagcuaagauuaucugggg

SEQ ID NO: 4805 - RNA, 27 nt, Artificial Sequence
  Description of Artificial Sequence: Synthetic oligonucleotide
gcuaagauuaucuggggaaaucaaaac

SEQ ID NO: 4806 - RNA, 27 nt, Artificial Sequence
  Description of Artificial Sequence: Synthetic oligonucleotide
cuggggaaaucaaaacaaaaacaagca

SEQ ID NO: 4807 - RNA, 27 nt, Artificial Sequence
  Description of Artificial Sequence: Synthetic oligonucleotide
gagccagcuugcugggagagcgggacg

SEQ ID NO: 4808 - RNA, 27 nt, Artificial Sequence
  Description of Artificial Sequence: Synthetic oligonucleotide
cggcuccagcgacagccaacgccucuu

SEQ ID NO: 4809 - RNA, 27 nt, Artificial Sequence
  Description of Artificial Sequence: Synthetic oligonucleotide
cagccaacgccucuugcagcgcggcgg

SEQ ID NO: 4810 - RNA, 27 nt, Artificial Sequence
  Description of Artificial Sequence: Synthetic oligonucleotide
gccucuugcagcgcggcggcuucgaag

SEQ ID NO: 4811 - RNA, 27 nt, Artificial Sequence
  Description of Artificial Sequence: Synthetic oligonucleotide
ugcagcgcggcggcuucgaagccgccg

SEQ ID NO: 4812 - RNA, 27 nt, Artificial Sequence
  Description of Artificial Sequence: Synthetic oligonucleotide
cgaagccgccgcccggagcugcccuuu

SEQ ID NO: 4813 - RNA, 27 nt, Artificial Sequence
  Description of Artificial Sequence: Synthetic oligonucleotide
cgccgcccggagcugcccuuuccucuu

SEQ ID NO: 4814 - RNA, 27 nt, Artificial Sequence
  Description of Artificial Sequence: Synthetic oligonucleotide
ugaaguuuuuaaaagcugcuaaagacu

SEQ ID NO: 4815 - RNA, 27 nt, Artificial Sequence
  Description of Artificial Sequence: Synthetic oligonucleotide
ccgucuucucucccgcagcugccucag

SEQ ID NO: 4816 - RNA, 27 nt, Artificial Sequence
  Description of Artificial Sequence: Synthetic oligonucleotide
ccgcagcugccucagucggcuacucuc

SEQ ID NO: 4817 - RNA, 27 nt, Artificial Sequence
  Description of Artificial Sequence: Synthetic oligonucleotide
uuuggcugcgagcgggcgagcuagcug

SEQ ID NO: 4818 - RNA, 27 nt, Artificial Sequence
  Description of Artificial Sequence: Synthetic oligonucleotide
cgggcgagcuagcugcacauugcaaag

SEQ ID NO: 4819 - RNA, 27 nt, Artificial Sequence
  Description of Artificial Sequence: Synthetic oligonucleotide
ucucucuccaccuccuccugccuuccc

SEQ ID NO: 4820 - RNA, 27 nt, Artificial Sequence
  Description of Artificial Sequence: Synthetic oligonucleotide
ccagagaucaaaagaugaaaaggcagu

SEQ ID NO: 4821 - RNA, 27 nt, Artificial Sequence
  Description of Artificial Sequence: Synthetic oligonucleotide
caguagccaaaaaacaaaacaaacaaa

SEQ ID NO: 4822 - RNA, 27 nt, Artificial Sequence
  Description of Artificial Sequence: Synthetic oligonucleotide
ccaaaaaacaaaacaaacaaaaacaaa

SEQ ID NO: 4823 - RNA, 27 nt, Artificial Sequence
  Description of Artificial Sequence: Synthetic oligonucleotide
acaaaacaaacaaaaacaaaaaagccg

SEQ ID NO: 4824 - RNA, 27 nt, Artificial Sequence
  Description of Artificial Sequence: Synthetic oligonucleotide
acaaaaaagccgaaauaaaagaaaaag

SEQ ID NO: 4825 - RNA, 27 nt, Artificial Sequence
  Description of Artificial Sequence: Synthetic oligonucleotide
gccgaaauaaaagaaaaagauaauaac

SEQ ID NO: 4826 - RNA, 27 nt, Artificial Sequence
  Description of Artificial Sequence: Synthetic oligonucleotide
aagaaaaagauaauaacucaguucuua

SEQ ID NO: 4827 - RNA, 27 nt, Artificial Sequence
  Description of Artificial Sequence: Synthetic oligonucleotide
aaagauaauaacucaguucuuauuugc

SEQ ID NO: 4828 - RNA, 27 nt, Artificial Sequence
  Description of Artificial Sequence: Synthetic oligonucleotide
gauaauaacucaguucuuauuugcacc

SEQ ID NO: 4829 - RNA, 27 nt, Artificial Sequence
  Description of Artificial Sequence: Synthetic oligonucleotide
uggaggauuuuguuuuuuucuuuuaag

SEQ ID NO: 4830 - RNA, 27 nt, Artificial Sequence
  Description of Artificial Sequence: Synthetic oligonucleotide
gauuuuguuuuuuucuuuuaagaucug

SEQ ID NO: 4831 - RNA, 27 nt, Artificial Sequence
  Description of Artificial Sequence: Synthetic oligonucleotide
guuuuuuucuuuuaagaucugggcauc

SEQ ID NO: 4832 - RNA, 27 nt, Artificial Sequence
  Description of Artificial Sequence: Synthetic oligonucleotide
gggcaucuuuugaaucuacccuucaag

SEQ ID NO: 4833 - RNA, 27 nt, Artificial Sequence
  Description of Artificial Sequence: Synthetic oligonucleotide
cagagcgcuuuuugcgugguugcuccc

SEQ ID NO: 4834 - RNA, 27 nt, Artificial Sequence
  Description of Artificial Sequence: Synthetic oligonucleotide
cgcuuuuugcgugguugcucccgcaag

SEQ ID NO: 4835 - RNA, 27 nt, Artificial Sequence
  Description of Artificial Sequence: Synthetic oligonucleotide
aaguuuccuucucuggagcuucccgca

SEQ ID NO: 4836 - RNA, 27 nt, Artificial Sequence
  Description of Artificial Sequence: Synthetic oligonucleotide
agcuucccgcaggugggcagcuagcug

SEQ ID NO: 4837 - RNA, 27 nt, Artificial Sequence
  Description of Artificial Sequence: Synthetic oligonucleotide
gugggcagcuagcugcagcgacuaccg

SEQ ID NO: 4838 - RNA, 27 nt, Artificial Sequence
  Description of Artificial Sequence: Synthetic oligonucleotide
aagugcaguuagggcugggaagggucu

SEQ ID NO: 4839 - RNA, 27 nt, Artificial Sequence
  Description of Artificial Sequence: Synthetic oligonucleotide
agugcaguuagggcugggaagggucua

SEQ ID NO: 4840 - RNA, 27 nt, Artificial Sequence
  Description of Artificial Sequence: Synthetic oligonucleotide
gugcaguuagggcugggaagggucuac

SEQ ID NO: 4841 - RNA, 27 nt, Artificial Sequence
  Description of Artificial Sequence: Synthetic oligonucleotide
ugcaguuagggcugggaagggucuacc

SEQ ID NO: 4842 - RNA, 27 nt, Artificial Sequence
  Description of Artificial Sequence: Synthetic oligonucleotide
gcaguuagggcugggaagggucuaccc

SEQ ID NO: 4843 - RNA, 27 nt, Artificial Sequence
  Description of Artificial Sequence: Synthetic oligonucleotide
caguuagggcugggaagggucuacccu

SEQ ID NO: 4844 - RNA, 27 nt, Artificial Sequence
  Description of Artificial Sequence: Synthetic oligonucleotide
aguuagggcugggaagggucuacccuc

SEQ ID NO: 4845 - RNA, 27 nt, Artificial Sequence
  Description of Artificial Sequence: Synthetic oligonucleotide
guuagggcugggaagggucuacccucg

SEQ ID NO: 4846 - RNA, 27 nt, Artificial Sequence
  Description of Artificial Sequence: Synthetic oligonucleotide
uuagggcugggaagggucuacccucgg

SEQ ID NO: 4847 - RNA, 27 nt, Artificial Sequence
  Description of Artificial Sequence: Synthetic oligonucleotide
uagggcugggaagggucuacccucggc

SEQ ID NO: 4848 - RNA, 27 nt, Artificial Sequence
  Description of Artificial Sequence: Synthetic oligonucleotide
agggcugggaagggucuacccucggcc

SEQ ID NO: 4849 - RNA, 27 nt, Artificial Sequence
  Description of Artificial Sequence: Synthetic oligonucleotide
cuuuccagaaucuguuccagagcgugc

SEQ ID NO: 4850 - RNA, 27 nt, Artificial Sequence
  Description of Artificial Sequence: Synthetic oligonucleotide
uuuccagaaucuguuccagagcgugcg

SEQ ID NO: 4851 - RNA, 27 nt, Artificial Sequence
  Description of Artificial Sequence: Synthetic oligonucleotide
uuccagaaucuguuccagagcgugcgc

SEQ ID NO: 4852 - RNA, 27 nt, Artificial Sequence
  Description of Artificial Sequence: Synthetic oligonucleotide
uccagaaucuguuccagagcgugcgcg

SEQ ID NO: 4853 - RNA, 27 nt, Artificial Sequence
  Description of Artificial Sequence: Synthetic oligonucleotide
ccagaaucuguuccagagcgugcgcga

SEQ ID NO: 4854 - RNA, 27 nt, Artificial Sequence
  Description of Artificial Sequence: Synthetic oligonucleotide
cagaaucuguuccagagcgugcgcgaa

SEQ ID NO: 4855 - RNA, 27 nt, Artificial Sequence
  Description of Artificial Sequence: Synthetic oligonucleotide
agaaucuguuccagagcgugcgcgaag

SEQ ID NO: 4856 - RNA, 27 nt, Artificial Sequence
  Description of Artificial Sequence: Synthetic oligonucleotide
gaaucuguuccagagcgugcgcgaagu

SEQ ID NO: 4857 - RNA, 27 nt, Artificial Sequence
  Description of Artificial Sequence: Synthetic oligonucleotide
aaucuguuccagagcgugcgcgaagug

SEQ ID NO: 4858 - RNA, 27 nt, Artificial Sequence
  Description of Artificial Sequence: Synthetic oligonucleotide
aucuguuccagagcgugcgcgaaguga

SEQ ID NO: 4859 - RNA, 27 nt, Artificial Sequence
  Description of Artificial Sequence: Synthetic oligonucleotide
ucuguuccagagcgugcgcgaagugau

SEQ ID NO: 4860 - RNA, 27 nt, Artificial Sequence
  Description of Artificial Sequence: Synthetic oligonucleotide
cuguuccagagcgugcgcgaagugauc

SEQ ID NO: 4861 - RNA, 27 nt, Artificial Sequence
  Description of Artificial Sequence: Synthetic oligonucleotide
uguuccagagcgugcgcgaagugaucc

SEQ ID NO: 4862 - RNA, 27 nt, Artificial Sequence
  Description of Artificial Sequence: Synthetic oligonucleotide
ggcgccaguuugcugcugcugcagcag

SEQ ID NO: 4863 - RNA, 27 nt, Artificial Sequence
  Description of Artificial Sequence: Synthetic oligonucleotide
uugcugcugcugcagcagcagcagcag

SEQ ID NO: 4864 - RNA, 27 nt, Artificial Sequence
  Description of Artificial Sequence: Synthetic oligonucleotide
gcgucccagagccuggagccgccgugg

SEQ ID NO: 4865 - RNA, 27 nt, Artificial Sequence
  Description of Artificial Sequence: Synthetic oligonucleotide
ggcugccgcagcagcugccagcaccuc

SEQ ID NO: 4866 - RNA, 27 nt, Artificial Sequence
  Description of Artificial Sequence: Synthetic oligonucleotide
cgcagcagcugccagcaccuccggacg

SEQ ID NO: 4867 - RNA, 27 nt, Artificial Sequence
  Description of Artificial Sequence: Synthetic oligonucleotide
cccauccacguugucccugcugggccc

SEQ ID NO: 4868 - RNA, 27 nt, Artificial Sequence
  Description of Artificial Sequence: Synthetic oligonucleotide
ccggcuuaagcagcugcuccgcugacc

SEQ ID NO: 4869 - RNA, 27 nt, Artificial Sequence
  Description of Artificial Sequence: Synthetic oligonucleotide
cggcuuaagcagcugcuccgcugaccu

SEQ ID NO: 4870 - RNA, 27 nt, Artificial Sequence
  Description of Artificial Sequence: Synthetic oligonucleotide
uaagcagcugcuccgcugaccuuaaag

SEQ ID NO: 4871 - RNA, 27 nt, Artificial Sequence
  Description of Artificial Sequence: Synthetic oligonucleotide
augcaacuccuucagcaacagcagcag

SEQ ID NO: 4872 - RNA, 27 nt, Artificial Sequence
  Description of Artificial Sequence: Synthetic oligonucleotide
accauuucugacaacgccaaggaguug

SEQ ID NO: 4873 - RNA, 27 nt, Artificial Sequence
  Description of Artificial Sequence: Synthetic oligonucleotide
ccacuuuugggaguuccacccgcugug

SEQ ID NO: 4874 - RNA, 27 nt, Artificial Sequence
  Description of Artificial Sequence: Synthetic oligonucleotide
caggcaagagcacugaagauacugcug

SEQ ID NO: 4875 - RNA, 27 nt, Artificial Sequence
  Description of Artificial Sequence: Synthetic oligonucleotide
cuggcagcgcugcagcagggagcuccg

SEQ ID NO: 4876 - RNA, 27 nt, Artificial Sequence
  Description of Artificial Sequence: Synthetic oligonucleotide
agucgcgacuacuacaacuuuccacug

SEQ ID NO: 4877 - RNA, 27 nt, Artificial Sequence
  Description of Artificial Sequence: Synthetic oligonucleotide
gucgcgacuacuacaacuuuccacugg

SEQ ID NO: 4878 - RNA, 27 nt, Artificial Sequence
  Description of Artificial Sequence: Synthetic oligonucleotide
ucgcgacuacuacaacuuuccacuggc

SEQ ID NO: 4879 - RNA, 27 nt, Artificial Sequence
  Description of Artificial Sequence: Synthetic oligonucleotide
gcucgcaucaagcuggagaacccgcug

SEQ ID NO: 4880 - RNA, 27 nt, Artificial Sequence
  Description of Artificial Sequence: Synthetic oligonucleotide
gcuggacuacggcagcgccugggcggc

SEQ ID NO: 4881 - RNA, 27 nt, Artificial Sequence
  Description of Artificial Sequence: Synthetic oligonucleotide
cuggacuacggcagcgccugggcggcu

SEQ ID NO: 4882 - RNA, 27 nt, Artificial Sequence
  Description of Artificial Sequence: Synthetic oligonucleotide
uggacuacggcagcgccugggcggcug

SEQ ID NO: 4883 - RNA, 27 nt, Artificial Sequence
  Description of Artificial Sequence: Synthetic oligonucleotide
ggacuacggcagcgccugggcggcugc

SEQ ID NO: 4884 - RNA, 27 nt, Artificial Sequence
  Description of Artificial Sequence: Synthetic oligonucleotide
uggcgcgggugcagcgggacccgguuc

SEQ ID NO: 4885 - RNA, 27 nt, Artificial Sequence
  Description of Artificial Sequence: Synthetic oligonucleotide
ggcuggcgggccaggaaagcgacuuca

SEQ ID NO: 4886 - RNA, 27 nt, Artificial Sequence
  Description of Artificial Sequence: Synthetic oligonucleotide
guacccuggcggcauggugagcagagu

SEQ ID NO: 4887 - RNA, 27 nt, Artificial Sequence
  Description of Artificial Sequence: Synthetic oligonucleotide
uggauggauagcuacuccggaccuuac

SEQ ID NO: 4888 - RNA, 27 nt, Artificial Sequence
  Description of Artificial Sequence: Synthetic oligonucleotide
cccagaagaccugccugaucuguggag

SEQ ID NO: 4889 - RNA, 27 nt, Artificial Sequence
  Description of Artificial Sequence: Synthetic oligonucleotide
ccagaagaccugccugaucuguggaga

SEQ ID NO: 4890 - RNA, 27 nt, Artificial Sequence
  Description of Artificial Sequence: Synthetic oligonucleotide
cagaagaccugccugaucuguggagau

SEQ ID NO: 4891 - RNA, 27 nt, Artificial Sequence
  Description of Artificial Sequence: Synthetic oligonucleotide
agaagaccugccugaucuguggagaug

SEQ ID NO: 4892 - RNA, 27 nt, Artificial Sequence
  Description of Artificial Sequence: Synthetic oligonucleotide
gaagaccugccugaucuguggagauga

SEQ ID NO: 4893 - RNA, 27 nt, Artificial Sequence
  Description of Artificial Sequence: Synthetic oligonucleotide
aagaccugccugaucuguggagaugaa

SEQ ID NO: 4894 - RNA, 27 nt, Artificial Sequence
  Description of Artificial Sequence: Synthetic oligonucleotide
agaccugccugaucuguggagaugaag

SEQ ID NO: 4895 - RNA, 27 nt, Artificial Sequence
  Description of Artificial Sequence: Synthetic oligonucleotide
gaccugccugaucuguggagaugaagc

SEQ ID NO: 4896 - RNA, 27 nt, Artificial Sequence
  Description of Artificial Sequence: Synthetic oligonucleotide
accugccugaucuguggagaugaagcu

SEQ ID NO: 4897 - RNA, 27 nt, Artificial Sequence
  Description of Artificial Sequence: Synthetic oligonucleotide
ccugccugaucuguggagaugaagcuu

SEQ ID NO: 4898 - RNA, 27 nt, Artificial Sequence
  Description of Artificial Sequence: Synthetic oligonucleotide
cugccugaucuguggagaugaagcuuc

SEQ ID NO: 4899 - RNA, 27 nt, Artificial Sequence
  Description of Artificial Sequence: Synthetic oligonucleotide
ugccugaucuguggagaugaagcuucu

SEQ ID NO: 4900 - RNA, 27 nt, Artificial Sequence
  Description of Artificial Sequence: Synthetic oligonucleotide
gccugaucuguggagaugaagcuucug

SEQ ID NO: 4901 - RNA, 27 nt, Artificial Sequence
  Description of Artificial Sequence: Synthetic oligonucleotide
ccugaucuguggagaugaagcuucugg

SEQ ID NO: 4902 - RNA, 27 nt, Artificial Sequence
  Description of Artificial Sequence: Synthetic oligonucleotide
cugaucuguggagaugaagcuucuggg

SEQ ID NO: 4903 - RNA, 27 nt, Artificial Sequence
  Description of Artificial Sequence: Synthetic oligonucleotide
ugaucuguggagaugaagcuucugggu

SEQ ID NO: 4904 - RNA, 27 nt, Artificial Sequence
  Description of Artificial Sequence: Synthetic oligonucleotide
gaucuguggagaugaagcuucugggug

SEQ ID NO: 4905 - RNA, 27 nt, Artificial Sequence
  Description of Artificial Sequence: Synthetic oligonucleotide
aucuguggagaugaagcuucugggugu

SEQ ID NO: 4906 - RNA, 27 nt, Artificial Sequence
  Description of Artificial Sequence: Synthetic oligonucleotide
ucuguggagaugaagcuucuggguguc

SEQ ID NO: 4907 - RNA, 27 nt, Artificial Sequence
  Description of Artificial Sequence: Synthetic oligonucleotide
cuguggagaugaagcuucuggguguca

SEQ ID NO: 4908 - RNA, 27 nt, Artificial Sequence
  Description of Artificial Sequence: Synthetic oligonucleotide
gcuucugggugucacuauggagcucuc

SEQ ID NO: 4909 - RNA, 27 nt, Artificial Sequence
  Description of Artificial Sequence: Synthetic oligonucleotide
uggagcucucacauguggaagcugcaa

SEQ ID NO: 4910 - RNA, 27 nt, Artificial Sequence
  Description of Artificial Sequence: Synthetic oligonucleotide
gaagcugcaaggucuucuucaaaagag

SEQ ID NO: 4911 - RNA, 27 nt, Artificial Sequence
  Description of Artificial Sequence: Synthetic oligonucleotide
aagcugcaaggucuucuucaaaagagc

SEQ ID NO: 4912 - RNA, 27 nt, Artificial Sequence
  Description of Artificial Sequence: Synthetic oligonucleotide
agcugcaaggucuucuucaaaagagcc

SEQ ID NO: 4913 - RNA, 27 nt, Artificial Sequence
  Description of Artificial Sequence: Synthetic oligonucleotide
gcugcaaggucuucuucaaaagagccg

SEQ ID NO: 4914 - RNA, 27 nt, Artificial Sequence
  Description of Artificial Sequence: Synthetic oligonucleotide
cugcaaggucuucuucaaaagagccgc

SEQ ID NO: 4915 - RNA, 27 nt, Artificial Sequence
  Description of Artificial Sequence: Synthetic oligonucleotide
ugcaaggucuucuucaaaagagccgcu

SEQ ID NO: 4916 - RNA, 27 nt, Artificial Sequence
  Description of Artificial Sequence: Synthetic oligonucleotide
gcaaggucuucuucaaaagagccgcug

SEQ ID NO: 4917 - RNA, 27 nt, Artificial Sequence
  Description of Artificial Sequence: Synthetic oligonucleotide
caaggucuucuucaaaagagccgcuga

SEQ ID NO: 4918 - RNA, 27 nt, Artificial Sequence
  Description of Artificial Sequence: Synthetic oligonucleotide
aaggucuucuucaaaagagccgcugaa

SEQ ID NO: 4919 - RNA, 27 nt, Artificial Sequence
  Description of Artificial Sequence: Synthetic oligonucleotide
aggucuucuucaaaagagccgcugaag

SEQ ID NO: 4920 - RNA, 27 nt, Artificial Sequence
  Description of Artificial Sequence: Synthetic oligonucleotide
ggucuucuucaaaagagccgcugaagg

SEQ ID NO: 4921 - RNA, 27 nt, Artificial Sequence
  Description of Artificial Sequence: Synthetic oligonucleotide
gucuucuucaaaagagccgcugaaggg

SEQ ID NO: 4922 - RNA, 27 nt, Artificial Sequence
  Description of Artificial Sequence: Synthetic oligonucleotide
ucuucuucaaaagagccgcugaaggga

SEQ ID NO: 4923 - RNA, 27 nt, Artificial Sequence
  Description of Artificial Sequence: Synthetic oligonucleotide
cuucuucaaaagagccgcugaagggaa

SEQ ID NO: 4924 - RNA, 27 nt, Artificial Sequence
  Description of Artificial Sequence: Synthetic oligonucleotide
uucuucaaaagagccgcugaagggaaa

SEQ ID NO: 4925 - RNA, 27 nt, Artificial Sequence
  Description of Artificial Sequence: Synthetic oligonucleotide
ucuucaaaagagccgcugaagggaaac

SEQ ID NO: 4926 - RNA, 27 nt, Artificial Sequence
  Description of Artificial Sequence: Synthetic oligonucleotide
cuucaaaagagccgcugaagggaaaca

SEQ ID NO: 4927 - RNA, 27 nt, Artificial Sequence
  Description of Artificial Sequence: Synthetic oligonucleotide
uucaaaagagccgcugaagggaaacag

SEQ ID NO: 4928 - RNA, 27 nt, Artificial Sequence
  Description of Artificial Sequence: Synthetic oligonucleotide
ucaaaagagccgcugaagggaaacaga

SEQ ID NO: 4929 - RNA, 27 nt, Artificial Sequence
  Description of Artificial Sequence: Synthetic oligonucleotide
caaaagagccgcugaagggaaacagaa

SEQ ID NO: 4930 - RNA, 27 nt, Artificial Sequence
  Description of Artificial Sequence: Synthetic oligonucleotide
aaaagagccgcugaagggaaacagaag

SEQ ID NO: 4931 - RNA, 27 nt, Artificial Sequence
  Description of Artificial Sequence: Synthetic oligonucleotide
aaagagccgcugaagggaaacagaagu

SEQ ID NO: 4932 - RNA, 27 nt, Artificial Sequence
  Description of Artificial Sequence: Synthetic oligonucleotide
aagagccgcugaagggaaacagaagua

SEQ ID NO: 4933 - RNA, 27 nt, Artificial Sequence
  Description of Artificial Sequence: Synthetic oligonucleotide
agagccgcugaagggaaacagaaguac

SEQ ID NO: 4934 - RNA, 27 nt, Artificial Sequence
  Description of Artificial Sequence: Synthetic oligonucleotide
gagccgcugaagggaaacagaaguacc

SEQ ID NO: 4935 - RNA, 27 nt, Artificial Sequence
  Description of Artificial Sequence: Synthetic oligonucleotide
agccgcugaagggaaacagaaguaccu

SEQ ID NO: 4936 - RNA, 27 nt, Artificial Sequence
  Description of Artificial Sequence: Synthetic oligonucleotide
ccgcugaagggaaacagaaguaccugu

SEQ ID NO: 4937 - RNA, 27 nt, Artificial Sequence
  Description of Artificial Sequence: Synthetic oligonucleotide
cgcugaagggaaacagaaguaccugug

SEQ ID NO: 4938 - RNA, 27 nt, Artificial Sequence
  Description of Artificial Sequence: Synthetic oligonucleotide
ccugugcgccagcagaaaugauugcac

SEQ ID NO: 4939 - RNA, 27 nt, Artificial Sequence
  Description of Artificial Sequence: Synthetic oligonucleotide
gcagaaaugauugcacuauugauaaau

SEQ ID NO: 4940 - RNA, 27 nt, Artificial Sequence
  Description of Artificial Sequence: Synthetic oligonucleotide
aaugauugcacuauugauaaauuccga

SEQ ID NO: 4941 - RNA, 27 nt, Artificial Sequence
  Description of Artificial Sequence: Synthetic oligonucleotide
cacuauugauaaauuccgaaggaaaaa

SEQ ID NO: 4942 - RNA, 27 nt, Artificial Sequence
  Description of Artificial Sequence: Synthetic oligonucleotide
uucggaaauguuaugaagcagggauga

SEQ ID NO: 4943 - RNA, 27 nt, Artificial Sequence
  Description of Artificial Sequence: Synthetic oligonucleotide
ucggaaauguuaugaagcagggaugac

SEQ ID NO: 4944 - RNA, 27 nt, Artificial Sequence
  Description of Artificial Sequence: Synthetic oligonucleotide
cggaaauguuaugaagcagggaugacu

SEQ ID NO: 4945 - RNA, 27 nt, Artificial Sequence
  Description of Artificial Sequence: Synthetic oligonucleotide
ggaaauguuaugaagcagggaugacuc

SEQ ID NO: 4946 - RNA, 27 nt, Artificial Sequence
  Description of Artificial Sequence: Synthetic oligonucleotide
gaaauguuaugaagcagggaugacucu

SEQ ID NO: 4947 - RNA, 27 nt, Artificial Sequence
  Description of Artificial Sequence: Synthetic oligonucleotide
aaauguuaugaagcagggaugacucug

SEQ ID NO: 4948 - RNA, 27 nt, Artificial Sequence
  Description of Artificial Sequence: Synthetic oligonucleotide
aauguuaugaagcagggaugacucugg

SEQ ID NO: 4949 - RNA, 27 nt, Artificial Sequence
  Description of Artificial Sequence: Synthetic oligonucleotide
auguuaugaagcagggaugacucuggg

SEQ ID NO: 4950 - RNA, 27 nt, Artificial Sequence
  Description of Artificial Sequence: Synthetic oligonucleotide
uguuaugaagcagggaugacucuggga

SEQ ID NO: 4951 - RNA, 27 nt, Artificial Sequence
  Description of Artificial Sequence: Synthetic oligonucleotide
guuaugaagcagggaugacucugggag

SEQ ID NO: 4952 - RNA, 27 nt, Artificial Sequence
  Description of Artificial Sequence: Synthetic oligonucleotide
uuaugaagcagggaugacucugggagc

SEQ ID NO: 4953 - RNA, 27 nt, Artificial Sequence
  Description of Artificial Sequence: Synthetic oligonucleotide
uaugaagcagggaugacucugggagcc

SEQ ID NO: 4954 - RNA, 27 nt, Artificial Sequence
  Description of Artificial Sequence: Synthetic oligonucleotide
augaagcagggaugacucugggagccc

SEQ ID NO: 4955 - RNA, 27 nt, Artificial Sequence
  Description of Artificial Sequence: Synthetic oligonucleotide
ugaagcagggaugacucugggagcccg

SEQ ID NO: 4956 - RNA, 27 nt, Artificial Sequence
  Description of Artificial Sequence: Synthetic oligonucleotide
gaagcagggaugacucugggagcccgg

SEQ ID NO: 4957 - RNA, 27 nt, Artificial Sequence
  Description of Artificial Sequence: Synthetic oligonucleotide
aagcagggaugacucugggagcccgga

SEQ ID NO: 4958 - RNA, 27 nt, Artificial Sequence
  Description of Artificial Sequence: Synthetic oligonucleotide
agcagggaugacucugggagcccggaa

SEQ ID NO: 4959 - RNA, 27 nt, Artificial Sequence
  Description of Artificial Sequence: Synthetic oligonucleotide
cugaagaaacuugguaaucugaaacua

SEQ ID NO: 4960 - RNA, 27 nt, Artificial Sequence
  Description of Artificial Sequence: Synthetic oligonucleotide
ugaaacuacaggaggaaggagaggcuu

SEQ ID NO: 4961 - RNA, 27 nt, Artificial Sequence
  Description of Artificial Sequence: Synthetic oligonucleotide
gaaacuacaggaggaaggagaggcuuc

SEQ ID NO: 4962 - RNA, 27 nt, Artificial Sequence
  Description of Artificial Sequence: Synthetic oligonucleotide
cacauugaaggcuaugaaugucagccc

SEQ ID NO: 4963 - RNA, 27 nt, Artificial Sequence
  Description of Artificial Sequence: Synthetic oligonucleotide
acauugaaggcuaugaaugucagccca

SEQ ID NO: 4964 - RNA, 27 nt, Artificial Sequence
  Description of Artificial Sequence: Synthetic oligonucleotide
cauugaaggcuaugaaugucagcccau

SEQ ID NO: 4965 - RNA, 27 nt, Artificial Sequence
  Description of Artificial Sequence: Synthetic oligonucleotide
auugaaggcuaugaaugucagcccauc

SEQ ID NO: 4966 - RNA, 27 nt, Artificial Sequence
  Description of Artificial Sequence: Synthetic oligonucleotide
uugaaggcuaugaaugucagcccaucu

SEQ ID NO: 4967 - RNA, 27 nt, Artificial Sequence
  Description of Artificial Sequence: Synthetic oligonucleotide
ugaaggcuaugaaugucagcccaucuu

SEQ ID NO: 4968 - RNA, 27 nt, Artificial Sequence
  Description of Artificial Sequence: Synthetic oligonucleotide
auguccuggaagccauugagccaggug

SEQ ID NO: 4969 - RNA, 27 nt, Artificial Sequence
  Description of Artificial Sequence: Synthetic oligonucleotide
uguccuggaagccauugagccaggugu

SEQ ID NO: 4970 - RNA, 27 nt, Artificial Sequence
  Description of Artificial Sequence: Synthetic oligonucleotide
guccuggaagccauugagccaggugua

SEQ ID NO: 4971 - RNA, 27 nt, Artificial Sequence
  Description of Artificial Sequence: Synthetic oligonucleotide
uccuggaagccauugagccagguguag

SEQ ID NO: 4972 - RNA, 27 nt, Artificial Sequence
  Description of Artificial Sequence: Synthetic oligonucleotide
ccuggaagccauugagccagguguagu

SEQ ID NO: 4973 - RNA, 27 nt, Artificial Sequence
  Description of Artificial Sequence: Synthetic oligonucleotide
accagcccgacuccuuugcagccuugc

SEQ ID NO: 4974 - RNA, 27 nt, Artificial Sequence
  Description of Artificial Sequence: Synthetic oligonucleotide
ccgacuccuuugcagccuugcucucua

SEQ ID NO: 4975 - RNA, 27 nt, Artificial Sequence
  Description of Artificial Sequence: Synthetic oligonucleotide
ugcagccuugcucucuagccucaauga

SEQ ID NO: 4976 - RNA, 27 nt, Artificial Sequence
  Description of Artificial Sequence: Synthetic oligonucleotide
acguggucaagugggccaaggccuugc

SEQ ID NO: 4977 - RNA, 27 nt, Artificial Sequence
  Description of Artificial Sequence: Synthetic oligonucleotide
cguggucaagugggccaaggccuugcc

SEQ ID NO: 4978 - RNA, 27 nt, Artificial Sequence
  Description of Artificial Sequence: Synthetic oligonucleotide
guggucaagugggccaaggccuugccu

SEQ ID NO: 4979 - RNA, 27 nt, Artificial Sequence
  Description of Artificial Sequence: Synthetic oligonucleotide
uggucaagugggccaaggccuugccug

SEQ ID NO: 4980 - RNA, 27 nt, Artificial Sequence
  Description of Artificial Sequence: Synthetic oligonucleotide
ggucaagugggccaaggccuugccugg

SEQ ID NO: 4981 - RNA, 27 nt, Artificial Sequence
  Description of Artificial Sequence: Synthetic oligonucleotide
gucaagugggccaaggccuugccuggc

SEQ ID NO: 4982 - RNA, 27 nt, Artificial Sequence
  Description of Artificial Sequence: Synthetic oligonucleotide
ucaagugggccaaggccuugccuggcu

SEQ ID NO: 4983 - RNA, 27 nt, Artificial Sequence
  Description of Artificial Sequence: Synthetic oligonucleotide
caagugggccaaggccuugccuggcuu

SEQ ID NO: 4984 - RNA, 27 nt, Artificial Sequence
  Description of Artificial Sequence: Synthetic oligonucleotide
aagugggccaaggccuugccuggcuuc

SEQ ID NO: 4985 - RNA, 27 nt, Artificial Sequence
  Description of Artificial Sequence: Synthetic oligonucleotide
agugggccaaggccuugccuggcuucc

SEQ ID NO: 4986 - RNA, 27 nt, Artificial Sequence
  Description of Artificial Sequence: Synthetic oligonucleotide
gugggccaaggccuugccuggcuuccg

SEQ ID NO: 4987 - RNA, 27 nt, Artificial Sequence
  Description of Artificial Sequence: Synthetic oligonucleotide
ugggccaaggccuugccuggcuuccgc

SEQ ID NO: 4988 - RNA, 27 nt, Artificial Sequence
  Description of Artificial Sequence: Synthetic oligonucleotide
gggccaaggccuugccuggcuuccgca

SEQ ID NO: 4989 - RNA, 27 nt, Artificial Sequence
  Description of Artificial Sequence: Synthetic oligonucleotide
ggccaaggccuugccuggcuuccgcaa

SEQ ID NO: 4990 - RNA, 27 nt, Artificial Sequence
  Description of Artificial Sequence: Synthetic oligonucleotide
gccaaggccuugccuggcuuccgcaac

SEQ ID NO: 4991 - RNA, 27 nt, Artificial Sequence
  Description of Artificial Sequence: Synthetic oligonucleotide
ccaaggccuugccuggcuuccgcaacu

SEQ ID NO: 4992 - RNA, 27 nt, Artificial Sequence
  Description of Artificial Sequence: Synthetic oligonucleotide
caaggccuugccuggcuuccgcaacuu

SEQ ID NO: 4993 - RNA, 27 nt, Artificial Sequence
  Description of Artificial Sequence: Synthetic oligonucleotide
aaggccuugccuggcuuccgcaacuua

SEQ ID NO: 4994 - RNA, 27 nt, Artificial Sequence
  Description of Artificial Sequence: Synthetic oligonucleotide
aggccuugccuggcuuccgcaacuuac

SEQ ID NO: 4995 - RNA, 27 nt, Artificial Sequence
  Description of Artificial Sequence: Synthetic oligonucleotide
ggccuugccuggcuuccgcaacuuaca

SEQ ID NO: 4996 - RNA, 27 nt, Artificial Sequence
  Description of Artificial Sequence: Synthetic oligonucleotide
gccuugccuggcuuccgcaacuuacac

SEQ ID NO: 4997 - RNA, 27 nt, Artificial Sequence
  Description of Artificial Sequence: Synthetic oligonucleotide
ccuugccuggcuuccgcaacuuacacg

SEQ ID NO: 4998 - RNA, 27 nt, Artificial Sequence
  Description of Artificial Sequence: Synthetic oligonucleotide
cuugccuggcuuccgcaacuuacacgu

SEQ ID NO: 4999 - RNA, 27 nt, Artificial Sequence
  Description of Artificial Sequence: Synthetic oligonucleotide
ccaaugucaacuccaggaugcucuacu

SEQ ID NO: 5000 - RNA, 27 nt, Artificial Sequence
  Description of Artificial Sequence: Synthetic oligonucleotide
caaugucaacuccaggaugcucuacuu

SEQ ID NO: 5001 - RNA, 27 nt, Artificial Sequence
  Description of Artificial Sequence: Synthetic oligonucleotide
aaugucaacuccaggaugcucuacuuc

SEQ ID NO: 5002 - RNA, 27 nt, Artificial Sequence
  Description of Artificial Sequence: Synthetic oligonucleotide
augucaacuccaggaugcucuacuucg

SEQ ID NO: 5003 - RNA, 27 nt, Artificial Sequence
  Description of Artificial Sequence: Synthetic oligonucleotide
ugucaacuccaggaugcucuacuucgc

SEQ ID NO: 5004 - RNA, 27 nt, Artificial Sequence
  Description of Artificial Sequence: Synthetic oligonucleotide
gucaacuccaggaugcucuacuucgcc

SEQ ID NO: 5005 - RNA, 27 nt, Artificial Sequence
  Description of Artificial Sequence: Synthetic oligonucleotide
ucaacuccaggaugcucuacuucgccc

SEQ ID NO: 5006 - RNA, 27 nt, Artificial Sequence
  Description of Artificial Sequence: Synthetic oligonucleotide
ucugguuuucaaugaguaccgcaugca

SEQ ID NO: 5007 - RNA, 27 nt, Artificial Sequence
  Description of Artificial Sequence: Synthetic oligonucleotide
cugguuuucaaugaguaccgcaugcac

SEQ ID NO: 5008 - RNA, 27 nt, Artificial Sequence
  Description of Artificial Sequence: Synthetic oligonucleotide
ugguuuucaaugaguaccgcaugcaca

SEQ ID NO: 5009 - RNA, 27 nt, Artificial Sequence
  Description of Artificial Sequence: Synthetic oligonucleotide
gguuuucaaugaguaccgcaugcacaa

SEQ ID NO: 5010 - RNA, 27 nt, Artificial Sequence
  Description of Artificial Sequence: Synthetic oligonucleotide
guuuucaaugaguaccgcaugcacaag

SEQ ID NO: 5011 - RNA, 27 nt, Artificial Sequence
  Description of Artificial Sequence: Synthetic oligonucleotide
uuuucaaugaguaccgcaugcacaagu

SEQ ID NO: 5012 - RNA, 27 nt, Artificial Sequence
  Description of Artificial Sequence: Synthetic oligonucleotide
uuucaaugaguaccgcaugcacaaguc

SEQ ID NO: 5013 - RNA, 27 nt, Artificial Sequence
  Description of Artificial Sequence: Synthetic oligonucleotide
uucaaugaguaccgcaugcacaagucc

SEQ ID NO: 5014 - RNA, 27 nt, Artificial Sequence
  Description of Artificial Sequence: Synthetic oligonucleotide
ucaaugaguaccgcaugcacaaguccc

SEQ ID NO: 5015 - RNA, 27 nt, Artificial Sequence
  Description of Artificial Sequence: Synthetic oligonucleotide
caaugaguaccgcaugcacaagucccg

SEQ ID NO: 5016 - RNA, 27 nt, Artificial Sequence
  Description of Artificial Sequence: Synthetic oligonucleotide
aaugaguaccgcaugcacaagucccgg

SEQ ID NO: 5017 - RNA, 27 nt, Artificial Sequence
  Description of Artificial Sequence: Synthetic oligonucleotide
augaguaccgcaugcacaagucccgga

SEQ ID NO: 5018 - RNA, 27 nt, Artificial Sequence
  Description of Artificial Sequence: Synthetic oligonucleotide
ugaguaccgcaugcacaagucccggau

SEQ ID NO: 5019 - RNA, 27 nt, Artificial Sequence
  Description of Artificial Sequence: Synthetic oligonucleotide
ucucucaagaguuuggauggcuccaaa

SEQ ID NO: 5020 - RNA, 27 nt, Artificial Sequence
  Description of Artificial Sequence: Synthetic oligonucleotide
cucucaagaguuuggauggcuccaaau

SEQ ID NO: 5021 - RNA, 27 nt, Artificial Sequence
  Description of Artificial Sequence: Synthetic oligonucleotide
ucucaagaguuuggauggcuccaaauc

SEQ ID NO: 5022 - RNA, 27 nt, Artificial Sequence
  Description of Artificial Sequence: Synthetic oligonucleotide
cucaagaguuuggauggcuccaaauca

SEQ ID NO: 5023 - RNA, 27 nt, Artificial Sequence
  Description of Artificial Sequence: Synthetic oligonucleotide
ucaagaguuuggauggcuccaaaucac

SEQ ID NO: 5024 - RNA, 27 nt, Artificial Sequence
  Description of Artificial Sequence: Synthetic oligonucleotide
caagaguuuggauggcuccaaaucacc

SEQ ID NO: 5025 - RNA, 27 nt, Artificial Sequence
  Description of Artificial Sequence: Synthetic oligonucleotide
aagaguuuggauggcuccaaaucaccc

SEQ ID NO: 5026 - RNA, 27 nt, Artificial Sequence
  Description of Artificial Sequence: Synthetic oligonucleotide
cccaggaauuccugugcaugaaagcac

SEQ ID NO: 5027 - RNA, 27 nt, Artificial Sequence
  Description of Artificial Sequence: Synthetic oligonucleotide
ccaggaauuccugugcaugaaagcacu

SEQ ID NO: 5028 - RNA, 27 nt, Artificial Sequence
  Description of Artificial Sequence: Synthetic oligonucleotide
caggaauuccugugcaugaaagcacug

SEQ ID NO: 5029 - RNA, 27 nt, Artificial Sequence
  Description of Artificial Sequence: Synthetic oligonucleotide
aggaauuccugugcaugaaagcacugc

SEQ ID NO: 5030 - RNA, 27 nt, Artificial Sequence
  Description of Artificial Sequence: Synthetic oligonucleotide
ggaauuccugugcaugaaagcacugcu

SEQ ID NO: 5031 - RNA, 27 nt, Artificial Sequence
  Description of Artificial Sequence: Synthetic oligonucleotide
gaauuccugugcaugaaagcacugcua

SEQ ID NO: 5032 - RNA, 27 nt, Artificial Sequence
  Description of Artificial Sequence: Synthetic oligonucleotide
aauuccugugcaugaaagcacugcuac

SEQ ID NO: 5033 - RNA, 27 nt, Artificial Sequence
  Description of Artificial Sequence: Synthetic oligonucleotide
auuccugugcaugaaagcacugcuacu

SEQ ID NO: 5034 - RNA, 27 nt, Artificial Sequence
  Description of Artificial Sequence: Synthetic oligonucleotide
uuccugugcaugaaagcacugcuacuc

SEQ ID NO: 5035 - RNA, 27 nt, Artificial Sequence
  Description of Artificial Sequence: Synthetic oligonucleotide
uccugugcaugaaagcacugcuacucu

SEQ ID NO: 5036 - RNA, 27 nt, Artificial Sequence
  Description of Artificial Sequence: Synthetic oligonucleotide
ccugugcaugaaagcacugcuacucuu

SEQ ID NO: 5037 - RNA, 27 nt, Artificial Sequence
  Description of Artificial Sequence: Synthetic oligonucleotide
uacucuucagcauuauuccaguggaug

SEQ ID NO: 5038 - RNA, 27 nt, Artificial Sequence
  Description of Artificial Sequence: Synthetic oligonucleotide
acucuucagcauuauuccaguggaugg

SEQ ID NO: 5039 - RNA, 27 nt, Artificial Sequence
  Description of Artificial Sequence: Synthetic oligonucleotide
cucuucagcauuauuccaguggauggg

SEQ ID NO: 5040 - RNA, 27 nt, Artificial Sequence
  Description of Artificial Sequence: Synthetic oligonucleotide
ucuucagcauuauuccaguggaugggc

SEQ ID NO: 5041 - RNA, 27 nt, Artificial Sequence
  Description of Artificial Sequence: Synthetic oligonucleotide
cuucagcauuauuccaguggaugggcu

SEQ ID NO: 5042 - RNA, 27 nt, Artificial Sequence
  Description of Artificial Sequence: Synthetic oligonucleotide
uucagcauuauuccaguggaugggcug

SEQ ID NO: 5043 - RNA, 27 nt, Artificial Sequence
  Description of Artificial Sequence: Synthetic oligonucleotide
ucagcauuauuccaguggaugggcuga

SEQ ID NO: 5044 - RNA, 27 nt, Artificial Sequence
  Description of Artificial Sequence: Synthetic oligonucleotide
cagcauuauuccaguggaugggcugaa

SEQ ID NO: 5045 - RNA, 27 nt, Artificial Sequence
  Description of Artificial Sequence: Synthetic oligonucleotide
agcauuauuccaguggaugggcugaaa

SEQ ID NO: 5046 - RNA, 27 nt, Artificial Sequence
  Description of Artificial Sequence: Synthetic oligonucleotide
gcauuauuccaguggaugggcugaaaa

SEQ ID NO: 5047 - RNA, 27 nt, Artificial Sequence
  Description of Artificial Sequence: Synthetic oligonucleotide
cauuauuccaguggaugggcugaaaaa

SEQ ID NO: 5048 - RNA, 27 nt, Artificial Sequence
  Description of Artificial Sequence: Synthetic oligonucleotide
auuauuccaguggaugggcugaaaaau

SEQ ID NO: 5049 - RNA, 27 nt, Artificial Sequence
  Description of Artificial Sequence: Synthetic oligonucleotide
uuauuccaguggaugggcugaaaaauc

SEQ ID NO: 5050 - RNA, 27 nt, Artificial Sequence
  Description of Artificial Sequence: Synthetic oligonucleotide
uauuccaguggaugggcugaaaaauca

SEQ ID NO: 5051 - RNA, 27 nt, Artificial Sequence
  Description of Artificial Sequence: Synthetic oligonucleotide
auuccaguggaugggcugaaaaaucaa

SEQ ID NO: 5052 - RNA, 27 nt, Artificial Sequence
  Description of Artificial Sequence: Synthetic oligonucleotide
uuccaguggaugggcugaaaaaucaaa

SEQ ID NO: 5053 - RNA, 27 nt, Artificial Sequence
  Description of Artificial Sequence: Synthetic oligonucleotide
uccaguggaugggcugaaaaaucaaaa

SEQ ID NO: 5054 - RNA, 27 nt, Artificial Sequence
  Description of Artificial Sequence: Synthetic oligonucleotide
ccaguggaugggcugaaaaaucaaaaa

SEQ ID NO: 5055 - RNA, 27 nt, Artificial Sequence
  Description of Artificial Sequence: Synthetic oligonucleotide
caguggaugggcugaaaaaucaaaaau

SEQ ID NO: 5056 - RNA, 27 nt, Artificial Sequence
  Description of Artificial Sequence: Synthetic oligonucleotide
aguggaugggcugaaaaaucaaaaauu

SEQ ID NO: 5057 - RNA, 27 nt, Artificial Sequence
  Description of Artificial Sequence: Synthetic oligonucleotide
guggaugggcugaaaaaucaaaaauuc

SEQ ID NO: 5058 - RNA, 27 nt, Artificial Sequence
  Description of Artificial Sequence: Synthetic oligonucleotide
uggaugggcugaaaaaucaaaaauucu

SEQ ID NO: 5059 - RNA, 27 nt, Artificial Sequence
  Description of Artificial Sequence: Synthetic oligonucleotide
ggaugggcugaaaaaucaaaaauucuu

SEQ ID NO: 5060 - RNA, 27 nt, Artificial Sequence
  Description of Artificial Sequence: Synthetic oligonucleotide
gaugggcugaaaaaucaaaaauucuuu

SEQ ID NO: 5061 - RNA, 27 nt, Artificial Sequence
  Description of Artificial Sequence: Synthetic oligonucleotide
augggcugaaaaaucaaaaauucuuug

SEQ ID NO: 5062 - RNA, 27 nt, Artificial Sequence
  Description of Artificial Sequence: Synthetic oligonucleotide
ugggcugaaaaaucaaaaauucuuuga

SEQ ID NO: 5063 - RNA, 27 nt, Artificial Sequence
  Description of Artificial Sequence: Synthetic oligonucleotide
gggcugaaaaaucaaaaauucuuugau

SEQ ID NO: 5064 - RNA, 27 nt, Artificial Sequence
  Description of Artificial Sequence: Synthetic oligonucleotide
ggcugaaaaaucaaaaauucuuugaug

SEQ ID NO: 5065 - RNA, 27 nt, Artificial Sequence
  Description of Artificial Sequence: Synthetic oligonucleotide
gcugaaaaaucaaaaauucuuugauga

SEQ ID NO: 5066 - RNA, 27 nt, Artificial Sequence
  Description of Artificial Sequence: Synthetic oligonucleotide
cugaaaaaucaaaaauucuuugaugaa

SEQ ID NO: 5067 - RNA, 27 nt, Artificial Sequence
  Description of Artificial Sequence: Synthetic oligonucleotide
ugaaaaaucaaaaauucuuugaugaac

SEQ ID NO: 5068 - RNA, 27 nt, Artificial Sequence
  Description of Artificial Sequence: Synthetic oligonucleotide
aaaaaucaaaaauucuuugaugaacuu

SEQ ID NO: 5069 - RNA, 27 nt, Artificial Sequence
  Description of Artificial Sequence: Synthetic oligonucleotide
aaaaucaaaaauucuuugaugaacuuc

SEQ ID NO: 5070 - RNA, 27 nt, Artificial Sequence
  Description of Artificial Sequence: Synthetic oligonucleotide
aaaucaaaaauucuuugaugaacuucg

SEQ ID NO: 5071 - RNA, 27 nt, Artificial Sequence
  Description of Artificial Sequence: Synthetic oligonucleotide
aaucaaaaauucuuugaugaacuucga

SEQ ID NO: 5072 - RNA, 27 nt, Artificial Sequence
  Description of Artificial Sequence: Synthetic oligonucleotide
aucaaaaauucuuugaugaacuucgaa

SEQ ID NO: 5073 - RNA, 27 nt, Artificial Sequence
  Description of Artificial Sequence: Synthetic oligonucleotide
ucaaaaauucuuugaugaacuucgaau

SEQ ID NO: 5074 - RNA, 27 nt, Artificial Sequence
  Description of Artificial Sequence: Synthetic oligonucleotide
caaaaauucuuugaugaacuucgaaug

SEQ ID NO: 5075 - RNA, 27 nt, Artificial Sequence
  Description of Artificial Sequence: Synthetic oligonucleotide
aaaaauucuuugaugaacuucgaauga

SEQ ID NO: 5076 - RNA, 27 nt, Artificial Sequence
  Description of Artificial Sequence: Synthetic oligonucleotide
aaaauucuuugaugaacuucgaaugaa

SEQ ID NO: 5077 - RNA, 27 nt, Artificial Sequence
  Description of Artificial Sequence: Synthetic oligonucleotide
aaauucuuugaugaacuucgaaugaac

SEQ ID NO: 5078 - RNA, 27 nt, Artificial Sequence
  Description of Artificial Sequence: Synthetic oligonucleotide
aauucuuugaugaacuucgaaugaacu

SEQ ID NO: 5079 - RNA, 27 nt, Artificial Sequence
  Description of Artificial Sequence: Synthetic oligonucleotide
auucuuugaugaacuucgaaugaacua

SEQ ID NO: 5080 - RNA, 27 nt, Artificial Sequence
  Description of Artificial Sequence: Synthetic oligonucleotide
uucuuugaugaacuucgaaugaacuac

SEQ ID NO: 5081 - RNA, 27 nt, Artificial Sequence
  Description of Artificial Sequence: Synthetic oligonucleotide
ucuuugaugaacuucgaaugaacuaca

SEQ ID NO: 5082 - RNA, 27 nt, Artificial Sequence
  Description of Artificial Sequence: Synthetic oligonucleotide
cuuugaugaacuucgaaugaacuacau

SEQ ID NO: 5083 - RNA, 27 nt, Artificial Sequence
  Description of Artificial Sequence: Synthetic oligonucleotide
uuugaugaacuucgaaugaacuacauc

SEQ ID NO: 5084 - RNA, 27 nt, Artificial Sequence
  Description of Artificial Sequence: Synthetic oligonucleotide
uugaugaacuucgaaugaacuacauca

SEQ ID NO: 5085 - RNA, 27 nt, Artificial Sequence
  Description of Artificial Sequence: Synthetic oligonucleotide
ugaugaacuucgaaugaacuacaucaa

SEQ ID NO: 5086 - RNA, 27 nt, Artificial Sequence
  Description of Artificial Sequence: Synthetic oligonucleotide
gaugaacuucgaaugaacuacaucaag

SEQ ID NO: 5087 - RNA, 27 nt, Artificial Sequence
  Description of Artificial Sequence: Synthetic oligonucleotide
augaacuucgaaugaacuacaucaagg

SEQ ID NO: 5088 - RNA, 27 nt, Artificial Sequence
  Description of Artificial Sequence: Synthetic oligonucleotide
ugaacuucgaaugaacuacaucaagga

SEQ ID NO: 5089 - RNA, 27 nt, Artificial Sequence
  Description of Artificial Sequence: Synthetic oligonucleotide
gaacuucgaaugaacuacaucaaggaa

SEQ ID NO: 5090 - RNA, 27 nt, Artificial Sequence
  Description of Artificial Sequence: Synthetic oligonucleotide
aacuucgaaugaacuacaucaaggaac

SEQ ID NO: 5091 - RNA, 27 nt, Artificial Sequence
  Description of Artificial Sequence: Synthetic oligonucleotide
acuucgaaugaacuacaucaaggaacu

SEQ ID NO: 5092 - RNA, 27 nt, Artificial Sequence
  Description of Artificial Sequence: Synthetic oligonucleotide
cuucgaaugaacuacaucaaggaacuc

SEQ ID NO: 5093 - RNA, 27 nt, Artificial Sequence
  Description of Artificial Sequence: Synthetic oligonucleotide
uucgaaugaacuacaucaaggaacucg

SEQ ID NO: 5094 - RNA, 27 nt, Artificial Sequence
  Description of Artificial Sequence: Synthetic oligonucleotide
ucgaaugaacuacaucaaggaacucga

SEQ ID NO: 5095 - RNA, 27 nt, Artificial Sequence
  Description of Artificial Sequence: Synthetic oligonucleotide
cgaaugaacuacaucaaggaacucgau

SEQ ID NO: 5096 - RNA, 27 nt, Artificial Sequence
  Description of Artificial Sequence: Synthetic oligonucleotide
gaaugaacuacaucaaggaacucgauc

SEQ ID NO: 5097 - RNA, 27 nt, Artificial Sequence
  Description of Artificial Sequence: Synthetic oligonucleotide
aaugaacuacaucaaggaacucgaucg

SEQ ID NO: 5098 - RNA, 27 nt, Artificial Sequence
  Description of Artificial Sequence: Synthetic oligonucleotide
augaacuacaucaaggaacucgaucgu

SEQ ID NO: 5099 - RNA, 27 nt, Artificial Sequence
  Description of Artificial Sequence: Synthetic oligonucleotide
ugaacuacaucaaggaacucgaucgua

SEQ ID NO: 5100 - RNA, 27 nt, Artificial Sequence
  Description of Artificial Sequence: Synthetic oligonucleotide
gaacuacaucaaggaacucgaucguau

SEQ ID NO: 5101 - RNA, 27 nt, Artificial Sequence
  Description of Artificial Sequence: Synthetic oligonucleotide
aacuacaucaaggaacucgaucguauc

SEQ ID NO: 5102 - RNA, 27 nt, Artificial Sequence
  Description of Artificial Sequence: Synthetic oligonucleotide
acuacaucaaggaacucgaucguauca

SEQ ID NO: 5103 - RNA, 27 nt, Artificial Sequence
  Description of Artificial Sequence: Synthetic oligonucleotide
cuacaucaaggaacucgaucguaucau

SEQ ID NO: 5104 - RNA, 27 nt, Artificial Sequence
  Description of Artificial Sequence: Synthetic oligonucleotide
guaucauugcaugcaaaagaaaaaauc

SEQ ID NO: 5105 - RNA, 27 nt, Artificial Sequence
  Description of Artificial Sequence: Synthetic oligonucleotide
uaucauugcaugcaaaagaaaaaaucc

SEQ ID NO: 5106 - RNA, 27 nt, Artificial Sequence
  Description of Artificial Sequence: Synthetic oligonucleotide
aaaaucccacauccugcucaagacgcu

SEQ ID NO: 5107 - RNA, 27 nt, Artificial Sequence
  Description of Artificial Sequence: Synthetic oligonucleotide
aaaucccacauccugcucaagacgcuu

SEQ ID NO: 5108 - RNA, 27 nt, Artificial Sequence
  Description of Artificial Sequence: Synthetic oligonucleotide
gacgcuucuaccagcucaccaagcucc

SEQ ID NO: 5109 - RNA, 27 nt, Artificial Sequence
  Description of Artificial Sequence: Synthetic oligonucleotide
acgcuucuaccagcucaccaagcuccu

SEQ ID NO: 5110 - RNA, 27 nt, Artificial Sequence
  Description of Artificial Sequence: Synthetic oligonucleotide
cgcuucuaccagcucaccaagcuccug

SEQ ID NO: 5111 - RNA, 27 nt, Artificial Sequence
  Description of Artificial Sequence: Synthetic oligonucleotide
gcuucuaccagcucaccaagcuccugg

SEQ ID NO: 5112 - RNA, 27 nt, Artificial Sequence
  Description of Artificial Sequence: Synthetic oligonucleotide
cuucuaccagcucaccaagcuccugga

SEQ ID NO: 5113 - RNA, 27 nt, Artificial Sequence
  Description of Artificial Sequence: Synthetic oligonucleotide
uucuaccagcucaccaagcuccuggac

SEQ ID NO: 5114 - RNA, 27 nt, Artificial Sequence
  Description of Artificial Sequence: Synthetic oligonucleotide
ucuaccagcucaccaagcuccuggacu

SEQ ID NO: 5115 - RNA, 27 nt, Artificial Sequence
  Description of Artificial Sequence: Synthetic oligonucleotide
cuaccagcucaccaagcuccuggacuc

SEQ ID NO: 5116 - RNA, 27 nt, Artificial Sequence
  Description of Artificial Sequence: Synthetic oligonucleotide
uaccagcucaccaagcuccuggacucc

SEQ ID NO: 5117 - RNA, 27 nt, Artificial Sequence
  Description of Artificial Sequence: Synthetic oligonucleotide
accagcucaccaagcuccuggacuccg

SEQ ID NO: 5118 - RNA, 27 nt, Artificial Sequence
  Description of Artificial Sequence: Synthetic oligonucleotide
ccagcucaccaagcuccuggacuccgu

SEQ ID NO: 5119 - RNA, 27 nt, Artificial Sequence
  Description of Artificial Sequence: Synthetic oligonucleotide
agcucaccaagcuccuggacuccgugc

SEQ ID NO: 5120 - RNA, 27 nt, Artificial Sequence
  Description of Artificial Sequence: Synthetic oligonucleotide
agcuccuggacuccgugcagccuauug

SEQ ID NO: 5121 - RNA, 27 nt, Artificial Sequence
  Description of Artificial Sequence: Synthetic oligonucleotide
uccgugcagccuauugcgagagagcug

SEQ ID NO: 5122 - RNA, 27 nt, Artificial Sequence
  Description of Artificial Sequence: Synthetic oligonucleotide
cgagagagcugcaucaguucacuuuug

SEQ ID NO: 5123 - RNA, 27 nt, Artificial Sequence
  Description of Artificial Sequence: Synthetic oligonucleotide
gagagagcugcaucaguucacuuuuga

SEQ ID NO: 5124 - RNA, 27 nt, Artificial Sequence
  Description of Artificial Sequence: Synthetic oligonucleotide
agagagcugcaucaguucacuuuugac

SEQ ID NO: 5125 - RNA, 27 nt, Artificial Sequence
  Description of Artificial Sequence: Synthetic oligonucleotide
gagagcugcaucaguucacuuuugacc

SEQ ID NO: 5126 - RNA, 27 nt, Artificial Sequence
  Description of Artificial Sequence: Synthetic oligonucleotide
agagcugcaucaguucacuuuugaccu

SEQ ID NO: 5127 - RNA, 27 nt, Artificial Sequence
  Description of Artificial Sequence: Synthetic oligonucleotide
gagcugcaucaguucacuuuugaccug

SEQ ID NO: 5128 - RNA, 27 nt, Artificial Sequence
  Description of Artificial Sequence: Synthetic oligonucleotide
agcugcaucaguucacuuuugaccugc

SEQ ID NO: 5129 - RNA, 27 nt, Artificial Sequence
  Description of Artificial Sequence: Synthetic oligonucleotide
gcugcaucaguucacuuuugaccugcu

SEQ ID NO: 5130 - RNA, 27 nt, Artificial Sequence
  Description of Artificial Sequence: Synthetic oligonucleotide
cugcaucaguucacuuuugaccugcua

SEQ ID NO: 5131 - RNA, 27 nt, Artificial Sequence
  Description of Artificial Sequence: Synthetic oligonucleotide
ugcaucaguucacuuuugaccugcuaa

SEQ ID NO: 5132 - RNA, 27 nt, Artificial Sequence
  Description of Artificial Sequence: Synthetic oligonucleotide
gcaucaguucacuuuugaccugcuaau

SEQ ID NO: 5133 - RNA, 27 nt, Artificial Sequence
  Description of Artificial Sequence: Synthetic oligonucleotide
caucaguucacuuuugaccugcuaauc

SEQ ID NO: 5134 - RNA, 27 nt, Artificial Sequence
  Description of Artificial Sequence: Synthetic oligonucleotide
aucaguucacuuuugaccugcuaauca

SEQ ID NO: 5135 - RNA, 27 nt, Artificial Sequence
  Description of Artificial Sequence: Synthetic oligonucleotide
ucaguucacuuuugaccugcuaaucaa

SEQ ID NO: 5136 - RNA, 27 nt, Artificial Sequence
  Description of Artificial Sequence: Synthetic oligonucleotide
caguucacuuuugaccugcuaaucaag

SEQ ID NO: 5137 - RNA, 27 nt, Artificial Sequence
  Description of Artificial Sequence: Synthetic oligonucleotide
aguucacuuuugaccugcuaaucaagu

SEQ ID NO: 5138 - RNA, 27 nt, Artificial Sequence
  Description of Artificial Sequence: Synthetic oligonucleotide
guucacuuuugaccugcuaaucaaguc

SEQ ID NO: 5139 - RNA, 27 nt, Artificial Sequence
  Description of Artificial Sequence: Synthetic oligonucleotide
uucacuuuugaccugcuaaucaaguca

SEQ ID NO: 5140 - RNA, 27 nt, Artificial Sequence
  Description of Artificial Sequence: Synthetic oligonucleotide
ucacuuuugaccugcuaaucaagucac

SEQ ID NO: 5141 - RNA, 27 nt, Artificial Sequence
  Description of Artificial Sequence: Synthetic oligonucleotide
cacuuuugaccugcuaaucaagucaca

SEQ ID NO: 5142 - RNA, 27 nt, Artificial Sequence
  Description of Artificial Sequence: Synthetic oligonucleotide
acuuuugaccugcuaaucaagucacac

SEQ ID NO: 5143 - RNA, 27 nt, Artificial Sequence
  Description of Artificial Sequence: Synthetic oligonucleotide
acauggugagcguggacuuuccggaaa

SEQ ID NO: 5144 - RNA, 27 nt, Artificial Sequence
  Description of Artificial Sequence: Synthetic oligonucleotide
cauggugagcguggacuuuccggaaau

SEQ ID NO: 5145 - RNA, 27 nt, Artificial Sequence
  Description of Artificial Sequence: Synthetic oligonucleotide
cggaaaugauggcagagaucaucucug

SEQ ID NO: 5146 - RNA, 27 nt, Artificial Sequence
  Description of Artificial Sequence: Synthetic oligonucleotide
ggaaaugauggcagagaucaucucugu

SEQ ID NO: 5147 - RNA, 27 nt, Artificial Sequence
  Description of Artificial Sequence: Synthetic oligonucleotide
gaaaugauggcagagaucaucucugug

SEQ ID NO: 5148 - RNA, 27 nt, Artificial Sequence
  Description of Artificial Sequence: Synthetic oligonucleotide
aaaugauggcagagaucaucucugugc

SEQ ID NO: 5149 - RNA, 27 nt, Artificial Sequence
  Description of Artificial Sequence: Synthetic oligonucleotide
aaugauggcagagaucaucucugugca

SEQ ID NO: 5150 - RNA, 27 nt, Artificial Sequence
  Description of Artificial Sequence: Synthetic oligonucleotide
augauggcagagaucaucucugugcaa

SEQ ID NO: 5151 - RNA, 27 nt, Artificial Sequence
  Description of Artificial Sequence: Synthetic oligonucleotide
ugauggcagagaucaucucugugcaag

SEQ ID NO: 5152 - RNA, 27 nt, Artificial Sequence
  Description of Artificial Sequence: Synthetic oligonucleotide
gauggcagagaucaucucugugcaagu

SEQ ID NO: 5153 - RNA, 27 nt, Artificial Sequence
  Description of Artificial Sequence: Synthetic oligonucleotide
auggcagagaucaucucugugcaagug

SEQ ID NO: 5154 - RNA, 27 nt, Artificial Sequence
  Description of Artificial Sequence: Synthetic oligonucleotide
uggcagagaucaucucugugcaagugc

SEQ ID NO: 5155 - RNA, 27 nt, Artificial Sequence
  Description of Artificial Sequence: Synthetic oligonucleotide
ggcagagaucaucucugugcaagugcc

SEQ ID NO: 5156 - RNA, 27 nt, Artificial Sequence
  Description of Artificial Sequence: Synthetic oligonucleotide
gcagagaucaucucugugcaagugccc

SEQ ID NO: 5157 - RNA, 27 nt, Artificial Sequence
  Description of Artificial Sequence: Synthetic oligonucleotide
cagagaucaucucugugcaagugccca

SEQ ID NO: 5158 - RNA, 27 nt, Artificial Sequence
  Description of Artificial Sequence: Synthetic oligonucleotide
agagaucaucucugugcaagugcccaa

SEQ ID NO: 5159 - RNA, 27 nt, Artificial Sequence
  Description of Artificial Sequence: Synthetic oligonucleotide
gagaucaucucugugcaagugcccaag

SEQ ID NO: 5160 - RNA, 27 nt, Artificial Sequence
  Description of Artificial Sequence: Synthetic oligonucleotide
agaucaucucugugcaagugcccaaga

SEQ ID NO: 5161 - RNA, 27 nt, Artificial Sequence
  Description of Artificial Sequence: Synthetic oligonucleotide
gaucaucucugugcaagugcccaagau

SEQ ID NO: 5162 - RNA, 27 nt, Artificial Sequence
  Description of Artificial Sequence: Synthetic oligonucleotide
aucaucucugugcaagugcccaagauc

SEQ ID NO: 5163 - RNA, 27 nt, Artificial Sequence
  Description of Artificial Sequence: Synthetic oligonucleotide
ucaucucugugcaagugcccaagaucc

SEQ ID NO: 5164 - RNA, 27 nt, Artificial Sequence
  Description of Artificial Sequence: Synthetic oligonucleotide
caucucugugcaagugcccaagauccu

SEQ ID NO: 5165 - RNA, 27 nt, Artificial Sequence
  Description of Artificial Sequence: Synthetic oligonucleotide
aucucugugcaagugcccaagauccuu

SEQ ID NO: 5166 - RNA, 27 nt, Artificial Sequence
  Description of Artificial Sequence: Synthetic oligonucleotide
ucucugugcaagugcccaagauccuuu

SEQ ID NO: 5167 - RNA, 27 nt, Artificial Sequence
  Description of Artificial Sequence: Synthetic oligonucleotide
cucugugcaagugcccaagauccuuuc

SEQ ID NO: 5168 - RNA, 27 nt, Artificial Sequence
  Description of Artificial Sequence: Synthetic oligonucleotide
ucugugcaagugcccaagauccuuucu

SEQ ID NO: 5169 - RNA, 27 nt, Artificial Sequence
  Description of Artificial Sequence: Synthetic oligonucleotide
cugugcaagugcccaagauccuuucug

SEQ ID NO: 5170 - RNA, 27 nt, Artificial Sequence
  Description of Artificial Sequence: Synthetic oligonucleotide
ugugcaagugcccaagauccuuucugg

SEQ ID NO: 5171 - RNA, 27 nt, Artificial Sequence
  Description of Artificial Sequence: Synthetic oligonucleotide
gugcaagugcccaagauccuuucuggg

SEQ ID NO: 5172 - RNA, 27 nt, Artificial Sequence
  Description of Artificial Sequence: Synthetic oligonucleotide
ugcaagugcccaagauccuuucuggga

SEQ ID NO: 5173 - RNA, 27 nt, Artificial Sequence
  Description of Artificial Sequence: Synthetic oligonucleotide
gcaagugcccaagauccuuucugggaa

SEQ ID NO: 5174 - RNA, 27 nt, Artificial Sequence
  Description of Artificial Sequence: Synthetic oligonucleotide
caagugcccaagauccuuucugggaaa

SEQ ID NO: 5175 - RNA, 27 nt, Artificial Sequence
  Description of Artificial Sequence: Synthetic oligonucleotide
aagugcccaagauccuuucugggaaag

SEQ ID NO: 5176 - RNA, 27 nt, Artificial Sequence
  Description of Artificial Sequence: Synthetic oligonucleotide
agugcccaagauccuuucugggaaagu

SEQ ID NO: 5177 - RNA, 27 nt, Artificial Sequence
  Description of Artificial Sequence: Synthetic oligonucleotide
gugcccaagauccuuucugggaaaguc

SEQ ID NO: 5178 - RNA, 27 nt, Artificial Sequence
  Description of Artificial Sequence: Synthetic oligonucleotide
ugcccaagauccuuucugggaaaguca

SEQ ID NO: 5179 - RNA, 27 nt, Artificial Sequence
  Description of Artificial Sequence: Synthetic oligonucleotide
gcccaagauccuuucugggaaagucaa

SEQ ID NO: 5180 - RNA, 27 nt, Artificial Sequence
  Description of Artificial Sequence: Synthetic oligonucleotide
cccaagauccuuucugggaaagucaag

SEQ ID NO: 5181 - RNA, 27 nt, Artificial Sequence
  Description of Artificial Sequence: Synthetic oligonucleotide
ccaagauccuuucugggaaagucaagc

SEQ ID NO: 5182 - RNA, 27 nt, Artificial Sequence
  Description of Artificial Sequence: Synthetic oligonucleotide
caagauccuuucugggaaagucaagcc

SEQ ID NO: 5183 - RNA, 27 nt, Artificial Sequence
  Description of Artificial Sequence: Synthetic oligonucleotide
aagauccuuucugggaaagucaagccc

SEQ ID NO: 5184 - RNA, 27 nt, Artificial Sequence
  Description of Artificial Sequence: Synthetic oligonucleotide
agauccuuucugggaaagucaagccca

SEQ ID NO: 5185 - RNA, 27 nt, Artificial Sequence
  Description of Artificial Sequence: Synthetic oligonucleotide
gauccuuucugggaaagucaagcccau

SEQ ID NO: 5186 - RNA, 27 nt, Artificial Sequence
  Description of Artificial Sequence: Synthetic oligonucleotide
auccuuucugggaaagucaagcccauc

SEQ ID NO: 5187 - RNA, 27 nt, Artificial Sequence
  Description of Artificial Sequence: Synthetic oligonucleotide
uccuuucugggaaagucaagcccaucu

SEQ ID NO: 5188 - RNA, 27 nt, Artificial Sequence
  Description of Artificial Sequence: Synthetic oligonucleotide
ccuuucugggaaagucaagcccaucua

SEQ ID NO: 5189 - RNA, 27 nt, Artificial Sequence
  Description of Artificial Sequence: Synthetic oligonucleotide
cuuucugggaaagucaagcccaucuau

SEQ ID NO: 5190 - RNA, 27 nt, Artificial Sequence
  Description of Artificial Sequence: Synthetic oligonucleotide
uuucugggaaagucaagcccaucuauu

SEQ ID NO: 5191 - RNA, 27 nt, Artificial Sequence
  Description of Artificial Sequence: Synthetic oligonucleotide
uucugggaaagucaagcccaucuauuu

SEQ ID NO: 5192 - RNA, 27 nt, Artificial Sequence
  Description of Artificial Sequence: Synthetic oligonucleotide
ucugggaaagucaagcccaucuauuuc

SEQ ID NO: 5193 - RNA, 27 nt, Artificial Sequence
  Description of Artificial Sequence: Synthetic oligonucleotide
cugggaaagucaagcccaucuauuucc

SEQ ID NO: 5194 - RNA, 27 nt, Artificial Sequence
  Description of Artificial Sequence: Synthetic oligonucleotide
ugggaaagucaagcccaucuauuucca

SEQ ID NO: 5195 - RNA, 27 nt, Artificial Sequence
  Description of Artificial Sequence: Synthetic oligonucleotide
gggaaagucaagcccaucuauuuccac

SEQ ID NO: 5196 - RNA, 27 nt, Artificial Sequence
  Description of Artificial Sequence: Synthetic oligonucleotide
ggaaagucaagcccaucuauuuccaca

SEQ ID NO: 5197 - RNA, 27 nt, Artificial Sequence
  Description of Artificial Sequence: Synthetic oligonucleotide
gaaagucaagcccaucuauuuccacac

SEQ ID NO: 5198 - RNA, 27 nt, Artificial Sequence
  Description of Artificial Sequence: Synthetic oligonucleotide
uucagaugucuucugccuguuauaacu

SEQ ID NO: 5199 - RNA, 27 nt, Artificial Sequence
  Description of Artificial Sequence: Synthetic oligonucleotide
ucagaugucuucugccuguuauaacuc

SEQ ID NO: 5200 - RNA, 27 nt, Artificial Sequence
  Description of Artificial Sequence: Synthetic oligonucleotide
cagaugucuucugccuguuauaacucu

SEQ ID NO: 5201 - RNA, 27 nt, Artificial Sequence
  Description of Artificial Sequence: Synthetic oligonucleotide
agaugucuucugccuguuauaacucug

SEQ ID NO: 5202 - RNA, 27 nt, Artificial Sequence
  Description of Artificial Sequence: Synthetic oligonucleotide
ggggaauuuccucuauugauguacagu

SEQ ID NO: 5203 - RNA, 27 nt, Artificial Sequence
  Description of Artificial Sequence: Synthetic oligonucleotide
uugcugggcuuuuuuuuucucuuucuc

SEQ ID NO: 5204 - RNA, 27 nt, Artificial Sequence
  Description of Artificial Sequence: Synthetic oligonucleotide
ugcugggcuuuuuuuuucucuuucucu

SEQ ID NO: 5205 - RNA, 27 nt, Artificial Sequence
  Description of Artificial Sequence: Synthetic oligonucleotide
gcuuuuuuuuucucuuucucuccuuuc

SEQ ID NO: 5206 - RNA, 27 nt, Artificial Sequence
  Description of Artificial Sequence: Synthetic oligonucleotide
uuuuuucucuuucucuccuuucuuuuu

SEQ ID NO: 5207 - RNA, 27 nt, Artificial Sequence
  Description of Artificial Sequence: Synthetic oligonucleotide
ucuuuuucuucuucccucccuaucuaa

SEQ ID NO: 5208 - RNA, 27 nt, Artificial Sequence
  Description of Artificial Sequence: Synthetic oligonucleotide
uguuguaugccuuuaaaucugugauga

SEQ ID NO: 5209 - RNA, 27 nt, Artificial Sequence
  Description of Artificial Sequence: Synthetic oligonucleotide
ugugcuuguuuacagcacuacucugug

SEQ ID NO: 5210 - RNA, 27 nt, Artificial Sequence
  Description of Artificial Sequence: Synthetic oligonucleotide
uuagagagcuaagauuaucuggggaaa

SEQ ID NO: 5211 - RNA, 27 nt, Artificial Sequence
  Description of Artificial Sequence: Synthetic oligonucleotide
ggggaaaucaaaacaaaaacaagcaaa

SEQ ID NO: 5212 - RNA, 27 nt, Artificial Sequence
  Description of Artificial Sequence: Synthetic oligonucleotide
cugugcaugaaagcacugcugcucuuc

SEQ ID NO: 5213 - RNA, 27 nt, Artificial Sequence
  Description of Artificial Sequence: Synthetic oligonucleotide
caugaaagcacugcugcucuucagcau

SEQ ID NO: 5214 - RNA, 27 nt, Artificial Sequence
  Description of Artificial Sequence: Synthetic oligonucleotide
agcacugcugcucuucagcauuauucc

SEQ ID NO: 5215 - RNA, 27 nt, Artificial Sequence
  Description of Artificial Sequence: Synthetic oligonucleotide
ugcugcucuucagcauuauuccagugg

SEQ ID NO: 5216 - RNA, 27 nt, Artificial Sequence
  Description of Artificial Sequence: Synthetic oligonucleotide
agcucaccaagcuccuggauucugugc

SEQ ID NO: 5217 - RNA, 27 nt, Artificial Sequence
  Description of Artificial Sequence: Synthetic oligonucleotide
agcuccuggauucugugcagccuauug

SEQ ID NO: 5218 - RNA, 27 nt, Artificial Sequence
  Description of Artificial Sequence: Synthetic oligonucleotide
cuggauucugugcagccuauugcaaga

SEQ ID NO: 5219 - RNA, 27 nt, Artificial Sequence
  Description of Artificial Sequence: Synthetic oligonucleotide
ucugugcagccuauugcaagagagcug

SEQ ID NO: 5220 - RNA, 27 nt, Artificial Sequence
  Description of Artificial Sequence: Synthetic oligonucleotide
cagccuauugcaagagagcugcaucag

SEQ ID NO: 5221 - RNA, 27 nt, Artificial Sequence
  Description of Artificial Sequence: Synthetic oligonucleotide
gcguggacuuuccugaaaugauggcag

SEQ ID NO: 5222 - RNA, 27 nt, Artificial Sequence
  Description of Artificial Sequence: Synthetic oligonucleotide
ucuucugccuguuauauaacucugcac

SEQ ID NO: 5223 - RNA, 27 nt, Artificial Sequence
  Description of Artificial Sequence: Synthetic oligonucleotide
ugcacuacuucucugcagugccuuggg

SEQ ID NO: 5224 - RNA, 27 nt, Artificial Sequence
  Description of Artificial Sequence: Synthetic oligonucleotide
uccugggcuucuccuucuuuuuuuuuc

SEQ ID NO: 5225 - RNA, 27 nt, Artificial Sequence
  Description of Artificial Sequence: Synthetic oligonucleotide
gcuucuccuucuuuuuuuuucuucuuc

SEQ ID NO: 5226 - RNA, 27 nt, Artificial Sequence
  Description of Artificial Sequence: Synthetic oligonucleotide
uucuuuuuuuuucuucuucccucccuc

SEQ ID NO: 5227 - RNA, 27 nt, Artificial Sequence
  Description of Artificial Sequence: Synthetic oligonucleotide
cugcugcguauuguggcuccugccuuu

SEQ ID NO: 5228 - RNA, 27 nt, Artificial Sequence
  Description of Artificial Sequence: Synthetic oligonucleotide
uguggcuccugccuuuguuuugauuuc

SEQ ID NO: 5229 - RNA, 27 nt, Artificial Sequence
  Description of Artificial Sequence: Synthetic oligonucleotide
cuccugccuuuguuuugauuucuguug

SEQ ID NO: 5230 - RNA, 21 nt, Artificial Sequence
  Description of Artificial Sequence: Synthetic oligonucleotide
gaaaaagauaauaacucaguu

SEQ ID NO: 5231 - RNA, 21 nt, Artificial Sequence
  Description of Artificial Sequence: Synthetic oligonucleotide
cugaguuauuaucuuuuucuu

SEQ ID NO: 5232 - RNA, 21 nt, Artificial Sequence
  Description of Artificial Sequence: Synthetic oligonucleotide
aagaaaaagauaauaacucag

SEQ ID NO: 5233 - RNA, 21 nt, Artificial Sequence
  Description of Artificial Sequence: Synthetic oligonucleotide
aagaaaaagauaauaacucca

SEQ ID NO: 5234 - RNA, 27 nt, Artificial Sequence
  Description of Artificial Sequence: Synthetic oligonucleotide
cucaucuccacagaucaggcaggucuu

SEQ ID NO: 5235 - RNA, 27 nt, Artificial Sequence
  Description of Artificial Sequence: Synthetic oligonucleotide
uccaucuccacagaucaggcaggucuu

SEQ ID NO: 5236 - RNA, 27 nt, Artificial Sequence
  Description of Artificial Sequence: Synthetic oligonucleotide
uuaaucuccacagaucaggcaggucuu

SEQ ID NO: 5237 - RNA, 27 nt, Artificial Sequence
  Description of Artificial Sequence: Synthetic oligonucleotide
uuccucuccacagaucaggcaggucuu

SEQ ID NO: 5238 - DNA, 25 bp, Artificial Sequence
  Description of Artificial Sequence: Synthetic oligonucleotide
  Description of Combined DNA/RNA Molecule: Synthetic oligonucleotide
ccugccugaucuguggagaugcagc

SEQ ID NO: 5239 - DNA, 25 bp, Artificial Sequence
  Description of Artificial Sequence: Synthetic oligonucleotide
  Description of Combined DNA/RNA Molecule: Synthetic oligonucleotide
ccugccugaucuguggagaugacgc

SEQ ID NO: 5240 - DNA, 25 bp, Artificial Sequence
  Description of Artificial Sequence: Synthetic oligonucleotide
  Description of Combined DNA/RNA Molecule: Synthetic oligonucleotide
ccugccugaucuguggagaugaaac

SEQ ID NO: 5241 - DNA, 25 bp, Artificial Sequence
  Description of Artificial Sequence: Synthetic oligonucleotide
  Description of Combined DNA/RNA Molecule: Synthetic oligonucleotide
ccugccugaucuguggagaugaaga

SEQ ID NO: 5242 - RNA, 27 nt, Artificial Sequence
  Description of Artificial Sequence: Synthetic oligonucleotide
acuucaucuccacagaucaggcagguc

SEQ ID NO: 5243 - RNA, 27 nt, Artificial Sequence
  Description of Artificial Sequence: Synthetic oligonucleotide
gauucaucuccacagaucaggcagguc

SEQ ID NO: 5244 - RNA, 27 nt, Artificial Sequence
  Description of Artificial Sequence: Synthetic oligonucleotide
gccucaucuccacagaucaggcagguc

SEQ ID NO: 5245 - RNA, 27 nt, Artificial Sequence
  Description of Artificial Sequence: Synthetic oligonucleotide
gcuccaucuccacagaucaggcagguc

SEQ ID NO: 5246 - DNA, 25 bp, Artificial Sequence
  Description of Artificial Sequence: Synthetic oligonucleotide
  Description of Combined DNA/RNA Molecule: Synthetic oligonucleotide
ugggcugaaaaaucaaaaauuautt

SEQ ID NO: 5247 - DNA, 25 bp, Artificial Sequence
  Description of Artificial Sequence: Synthetic oligonucleotide
  Description of Combined DNA/RNA Molecule: Synthetic oligonucleotide
ugggcugaaaaaucaaaaauucctt

SEQ ID NO: 5248 - DNA, 25 bp, Artificial Sequence
  Description of Artificial Sequence: Synthetic oligonucleotide
  Description of Combined DNA/RNA Molecule: Synthetic oligonucleotide
ugggcugaaaaaucaaaaauucuct

SEQ ID NO: 5249 - DNA, 25 bp, Artificial Sequence
  Description of Artificial Sequence: Synthetic oligonucleotide
  Description of Combined DNA/RNA Molecule: Synthetic oligonucleotide
ugggcugaaaaaucaaaaauucutc

SEQ ID NO: 5250 - RNA, 27 nt, Artificial Sequence
  Description of Artificial Sequence: Synthetic oligonucleotide
caagaauuuuugauuuuucagcccauc

SEQ ID NO: 5251 - RNA, 27 nt, Artificial Sequence
  Description of Artificial Sequence: Synthetic oligonucleotide
acagaauuuuugauuuuucagcccauc

SEQ ID NO: 5252 - RNA, 27 nt, Artificial Sequence
  Description of Artificial Sequence: Synthetic oligonucleotide
aacgaauuuuugauuuuucagcccauc

SEQ ID NO: 5253 - RNA, 27 nt, Artificial Sequence
  Description of Artificial Sequence: Synthetic oligonucleotide
aaaaaauuuuugauuuuucagcccauc

SEQ ID NO: 5254 - RNA, 27 nt, Artificial Sequence
  Description of Artificial Sequence: Synthetic oligonucleotide
ggcagcagcacacugaggaugguucca

SEQ ID NO: 5255 - RNA, 27 nt, Artificial Sequence
  Description of Artificial Sequence: Synthetic oligonucleotide
cuccgagggccacccugagagcagcca

SEQ ID NO: 5256 - RNA, 27 nt, Artificial Sequence
  Description of Artificial Sequence: Synthetic oligonucleotide
gggccacccugagagcagcugccucaa

SEQ ID NO: 5257 - RNA, 27 nt, Artificial Sequence
  Description of Artificial Sequence: Synthetic oligonucleotide
ggcugccgcagcagccaccagcuccca

SEQ ID NO: 5258 - RNA, 27 nt, Artificial Sequence
  Description of Artificial Sequence: Synthetic oligonucleotide
cacuuucccaggcuuaagcagcugcca

SEQ ID NO: 5259 - RNA, 27 nt, Artificial Sequence
  Description of Artificial Sequence: Synthetic oligonucleotide
augcaacuucuucagcagcagcaaccc

SEQ ID NO: 5260 - RNA, 27 nt, Artificial Sequence
  Description of Artificial Sequence: Synthetic oligonucleotide
gugcgucccacuccuugugcgccgcca

SEQ ID NO: 5261 - RNA, 27 nt, Artificial Sequence
  Description of Artificial Sequence: Synthetic oligonucleotide
cuggcagcagugaagcagguagcucca

SEQ ID NO: 5262 - RNA, 27 nt, Artificial Sequence
  Description of Artificial Sequence: Synthetic oligonucleotide
uuuccgcuggcucuguccgggccgcaa

SEQ ID NO: 5263 - RNA, 27 nt, Artificial Sequence
  Description of Artificial Sequence: Synthetic oligonucleotide
gcagcgccugggcugcggcggcagcaa

SEQ ID NO: 5264 - RNA, 27 nt, Artificial Sequence
  Description of Artificial Sequence: Synthetic oligonucleotide
gccugggcugcggcggcagcgcaauaa

SEQ ID NO: 5265 - RNA, 27 nt, Artificial Sequence
  Description of Artificial Sequence: Synthetic oligonucleotide
cugcggcggcagcgcaaugccgcuaca

SEQ ID NO: 5266 - RNA, 27 nt, Artificial Sequence
  Description of Artificial Sequence: Synthetic oligonucleotide
uguagccgggcccagcacuggaucgaa

SEQ ID NO: 5267 - RNA, 27 nt, Artificial Sequence
  Description of Artificial Sequence: Synthetic oligonucleotide
cuuccuggcauacucucuucacagcca

SEQ ID NO: 5268 - RNA, 27 nt, Artificial Sequence
  Description of Artificial Sequence: Synthetic oligonucleotide
agcagcccaagcgaugccgggccugcc

SEQ ID NO: 5269 - RNA, 27 nt, Artificial Sequence
  Description of Artificial Sequence: Synthetic oligonucleotide
gcuucuggcugucacuacggagcucca

SEQ ID NO: 5270 - RNA, 27 nt, Artificial Sequence
  Description of Artificial Sequence: Synthetic oligonucleotide
cggagcucucacuuguggcagcugccc

SEQ ID NO: 5271 - RNA, 27 nt, Artificial Sequence
  Description of Artificial Sequence: Synthetic oligonucleotide
cacuuguggcagcugcaaggucuuccc

SEQ ID NO: 5272 - RNA, 27 nt, Artificial Sequence
  Description of Artificial Sequence: Synthetic oligonucleotide
guggcagcugcaaggucuucuucaacc

SEQ ID NO: 5273 - RNA, 27 nt, Artificial Sequence
  Description of Artificial Sequence: Synthetic oligonucleotide
gggaugacucugggagcucguaagcca

SEQ ID NO: 5274 - RNA, 27 nt, Artificial Sequence
  Description of Artificial Sequence: Synthetic oligonucleotide
cugggagcucguaagcugaagaaaccc

SEQ ID NO: 5275 - RNA, 27 nt, Artificial Sequence
  Description of Artificial Sequence: Synthetic oligonucleotide
cagauuccuuugcugccuuguuauccc

SEQ ID NO: 5276 - RNA, 27 nt, Artificial Sequence
  Description of Artificial Sequence: Synthetic oligonucleotide
cuuugcugccuuguuaucuagccuccc

SEQ ID NO: 5277 - RNA, 27 nt, Artificial Sequence
  Description of Artificial Sequence: Synthetic oligonucleotide
uugccuggcuuccgcaacuugcaugca

SEQ ID NO: 5278 - RNA, 27 nt, Artificial Sequence
  Description of Artificial Sequence: Synthetic oligonucleotide
uggaugggacugaugguauuugccaca

SEQ ID NO: 5279 - RNA, 27 nt, Artificial Sequence
  Description of Artificial Sequence: Synthetic oligonucleotide
caggaugcucuacuuugcaccugaccc

SEQ ID NO: 5280 - RNA, 27 nt, Artificial Sequence
  Description of Artificial Sequence: Synthetic oligonucleotide
ugcucuacuuugcaccugacuuggucc

SEQ ID NO: 5281 - RNA, 27 nt, Artificial Sequence
  Description of Artificial Sequence: Synthetic oligonucleotide
cuuugcaccugacuugguuuucaauac

SEQ ID NO: 5282 - RNA, 27 nt, Artificial Sequence
  Description of Artificial Sequence: Synthetic oligonucleotide
gacuugguuuucaaugaguaccgcaca

SEQ ID NO: 5283 - RNA, 27 nt, Artificial Sequence
  Description of Artificial Sequence: Synthetic oligonucleotide
gaguaccgcaugcacaagucucggaca

SEQ ID NO: 5284 - RNA, 27 nt, Artificial Sequence
  Description of Artificial Sequence: Synthetic oligonucleotide
ggcagcagcacacugaggaugguucuc

SEQ ID NO: 5285 - RNA, 27 nt, Artificial Sequence
  Description of Artificial Sequence: Synthetic oligonucleotide
cuccgagggccacccugagagcagcug

SEQ ID NO: 5286 - RNA, 27 nt, Artificial Sequence
  Description of Artificial Sequence: Synthetic oligonucleotide
gggccacccugagagcagcugccuccc

SEQ ID NO: 5287 - RNA, 27 nt, Artificial Sequence
  Description of Artificial Sequence: Synthetic oligonucleotide
ggcugccgcagcagccaccagcuccuc

SEQ ID NO: 5288 - RNA, 27 nt, Artificial Sequence
  Description of Artificial Sequence: Synthetic oligonucleotide
cacuuucccaggcuuaagcagcugcuc

SEQ ID NO: 5289 - RNA, 27 nt, Artificial Sequence
  Description of Artificial Sequence: Synthetic oligonucleotide
augcaacuucuucagcagcagcaacaa

SEQ ID NO: 5290 - RNA, 27 nt, Artificial Sequence
  Description of Artificial Sequence: Synthetic oligonucleotide
gugcgucccacuccuugugcgccgcug

SEQ ID NO: 5291 - RNA, 27 nt, Artificial Sequence
  Description of Artificial Sequence: Synthetic oligonucleotide
cuggcagcagugaagcagguagcucug

SEQ ID NO: 5292 - RNA, 27 nt, Artificial Sequence
  Description of Artificial Sequence: Synthetic oligonucleotide
uuuccgcuggcucuguccgggccgccg

SEQ ID NO: 5293 - RNA, 27 nt, Artificial Sequence
  Description of Artificial Sequence: Synthetic oligonucleotide
gcagcgccugggcugcggcggcagcgc

SEQ ID NO: 5294 - RNA, 27 nt, Artificial Sequence
  Description of Artificial Sequence: Synthetic oligonucleotide
gccugggcugcggcggcagcgcaaugc

SEQ ID NO: 5295 - RNA, 27 nt, Artificial Sequence
  Description of Artificial Sequence: Synthetic oligonucleotide
cugcggcggcagcgcaaugccgcuaug

SEQ ID NO: 5296 - RNA, 27 nt, Artificial Sequence
  Description of Artificial Sequence: Synthetic oligonucleotide
uguagccgggcccagcacuggaucgcc

SEQ ID NO: 5297 - RNA, 27 nt, Artificial Sequence
  Description of Artificial Sequence: Synthetic oligonucleotide
cuuccuggcauacucucuucacagcug

SEQ ID NO: 5298 - RNA, 27 nt, Artificial Sequence
  Description of Artificial Sequence: Synthetic oligonucleotide
agcagcccaagcgaugccgggccugua

SEQ ID NO: 5299 - RNA, 27 nt, Artificial Sequence
  Description of Artificial Sequence: Synthetic oligonucleotide
gcuucuggcugucacuacggagcucuc

SEQ ID NO: 5300 - RNA, 27 nt, Artificial Sequence
  Description of Artificial Sequence: Synthetic oligonucleotide
cggagcucucacuuguggcagcugcaa

SEQ ID NO: 5301 - RNA, 27 nt, Artificial Sequence
  Description of Artificial Sequence: Synthetic oligonucleotide
cacuuguggcagcugcaaggucuucuu

SEQ ID NO: 5302 - RNA, 27 nt, Artificial Sequence
  Description of Artificial Sequence: Synthetic oligonucleotide
guggcagcugcaaggucuucuucaaaa

SEQ ID NO: 5303 - RNA, 27 nt, Artificial Sequence
  Description of Artificial Sequence: Synthetic oligonucleotide
gggaugacucugggagcucguaagcug

SEQ ID NO: 5304 - RNA, 27 nt, Artificial Sequence
  Description of Artificial Sequence: Synthetic oligonucleotide
cugggagcucguaagcugaagaaacuu

SEQ ID NO: 5305 - RNA, 27 nt, Artificial Sequence
  Description of Artificial Sequence: Synthetic oligonucleotide
cagauuccuuugcugccuuguuaucua

SEQ ID NO: 5306 - RNA, 27 nt, Artificial Sequence
  Description of Artificial Sequence: Synthetic oligonucleotide
cuuugcugccuuguuaucuagccucaa

SEQ ID NO: 5307 - RNA, 27 nt, Artificial Sequence
  Description of Artificial Sequence: Synthetic oligonucleotide
uugccuggcuuccgcaacuugcaugug

SEQ ID NO: 5308 - RNA, 27 nt, Artificial Sequence
  Description of Artificial Sequence: Synthetic oligonucleotide
uggaugggacugaugguauuugccaug

SEQ ID NO: 5309 - RNA, 27 nt, Artificial Sequence
  Description of Artificial Sequence: Synthetic oligonucleotide
caggaugcucuacuuugcaccugacuu

SEQ ID NO: 5310 - RNA, 27 nt, Artificial Sequence
  Description of Artificial Sequence: Synthetic oligonucleotide
ugcucuacuuugcaccugacuugguuu

SEQ ID NO: 5311 - RNA, 27 nt, Artificial Sequence
  Description of Artificial Sequence: Synthetic oligonucleotide
cuuugcaccugacuugguuuucaauga

SEQ ID NO: 5312 - RNA, 27 nt, Artificial Sequence
  Description of Artificial Sequence: Synthetic oligonucleotide
gacuugguuuucaaugaguaccgcaug

SEQ ID NO: 5313 - RNA, 27 nt, Artificial Sequence
  Description of Artificial Sequence: Synthetic oligonucleotide
gaguaccgcaugcacaagucucggaug

SEQ ID NO: 5314 - DNA, 25 bp, Artificial Sequence
  Description of Artificial Sequence: Synthetic oligonucleotide
  Description of Combined DNA/RNA Molecule: Synthetic oligonucleotide
gaccugccugaucuguggagacgaa

SEQ ID NO: 5315 - DNA, 25 bp, Artificial Sequence
  Description of Artificial Sequence: Synthetic oligonucleotide
  Description of Combined DNA/RNA Molecule: Synthetic oligonucleotide
gaccugccugaucuguggagauaaa

SEQ ID NO: 5316 - DNA, 25 bp, Artificial Sequence
  Description of Artificial Sequence: Synthetic oligonucleotide
  Description of Combined DNA/RNA Molecule: Synthetic oligonucleotide
gaccugccugaucuguggagaugca

SEQ ID NO: 5317 - DNA, 25 bp, Artificial Sequence
  Description of Artificial Sequence: Synthetic oligonucleotide
  Description of Combined DNA/RNA Molecule: Synthetic oligonucleotide
gaccugccugaucuguggagaugac

We claim:
1. An isolated double stranded ribonucleic acid (dsRNA) comprising first and second nucleic acid strands, wherein said first strand is 15-35 nucleotides in length and said second strand of said dsRNA is 19-35 nucleotides in length, wherein said second oligonucleotide strand is sufficiently complementary to SEQ ID NO: 2399 along at least 19 nucleotides of said second oligonucleotide strand length to reduce AR target gene expression when said double stranded nucleic acid is introduced into a mammalian cell.

2. The isolated dsRNA of claim 1 comprising a duplex region of at least 25 base pairs.

3. The isolated dsRNA of claim 1, wherein said second oligonucleotide strand comprises 1-5 single-stranded nucleotides at its 3' terminus.

4. The isolated dsRNA of claim 1, wherein said first strand is 25-35 nucleotides in length.

5. The isolated dsRNA of claim 1, wherein said second strand is 25-35 nucleotides in length.

6. The isolated dsRNA of claim 1, wherein said second oligonucleotide strand is complementary to a target AR cDNA sequence selected from the group consisting of GenBank Accession Nos. NM_000044.2 and NM_001011645.1 along at most 27 nucleotides of said second oligonucleotide strand length.

7. The isolated dsRNA of claim 1, wherein starting from the first nucleotide (position 1) at the 3' terminus of the first oligonucleotide strand, position 1, 2 and/or 3 is substituted with a modified nucleotide.

8. The isolated dsRNA of claim 1, wherein said 3' terminus of said first strand and said 5' terminus of said second strand form a blunt end.

9. The isolated dsRNA of claim 1, wherein said first strand is 25 nucleotides in length and said second strand is 27 nucleotides in length.

10. The isolated dsRNA of claim 1, wherein said second strand comprises a sequence selected from the group consisting of SEQ ID NOs: 1994 and 5242-5245.

11. The isolated dsRNA of claim 1, wherein said first strand comprises a sequence selected from the group consisting of SEQ ID NOs: 1589, 2804, 5238-5241, 4172 and 4895.

12. The isolated dsRNA of claim 7, wherein said modified nucleotide residue of said 3' terminus of said first strand is selected from the group consisting of a deoxyribonucleotide, an acyclonucleotide and a fluorescent molecule.

13. The isolated dsRNA of claim 1, wherein said dsRNA is cleaved endogenously in said cell by Dicer.

14. The isolated dsRNA of claim 1, wherein the amount of said isolated double stranded nucleic acid sufficient to reduce expression of the target gene is selected from the group consisting of 1 nanomolar or less, 200 picomolar or less, 100 picomolar or less, 50 picomolar or less, 20 picomolar or less, 10 picomolar or less, 5 picomolar or less, 2, picomolar or less and 1 picomolar or less in the environment of said cell.

15. The isolated dsRNA of claim 1, wherein said isolated dsRNA possesses greater potency than an isolated 21mer siRNA directed to the identical at least 19 nucleotides of said target AR cDNA in reducing target AR gene expression when assayed in vitro in a mammalian cell at an effective concentration in the environment of a cell of 1 nanomolar or less.

16. The isolated dsRNA of claim 1, wherein said isolated dsRNA is sufficiently complementary to the target AR cDNA sequence to reduce AR target gene expression by an amount (expressed by %) selected from the group consisting of at least 10%, at least 50%, at least 80-90%, at least 95%, at least 98%, and at least 99% when said double stranded nucleic acid is introduced into a mammalian cell.

17. The isolated dsRNA of claim 1, wherein the first and second strands are joined by a chemical linker.

18. The isolated double stranded nucleic acid of claim 1 comprising a modification selected from the group consisting of a morpholino nucleic acid and a peptide nucleic acid (PNA).

19. A method for reducing expression of a target AR gene in a mammalian cell comprising contacting a mammalian cell in vitro with an isolated dsRNA of claim 1 in an amount sufficient to reduce expression of a target AR gene in said cell.

20. The method of claim 19, wherein target AR gene expression is reduced by an amount (expressed by %) selected from the group consisting of at least 10%, at least 50% and at least 80-90%.

21. A method for reducing expression of a target AR gene in a mammal comprising administering an isolated dsRNA of claim 1 to a mammal in an amount sufficient to reduce expression of a target AR gene in the mammal.

22. The method of claim 21, wherein said isolated dsRNA is administered at a dosage selected from the group consisting of 1 microgram to 5 milligrams per kilogram of said mammal per day, 100 micrograms to 0.5 milligrams per kilogram, 0.001 to 0.25 milligrams per kilogram, 0.01 to 20 micrograms per kilogram, 0.01 to 10 micrograms per kilogram, 0.10 to 5 micrograms per kilogram, and 0.1 to 2.5 micrograms per kilogram.

23. The method of claim 22, wherein said administering step comprises a mode selected from the group consisting of intravenous injection, intramuscular injection, intraperitoneal injection, infusion, subcutaneous injection, transdermal, aerosol, rectal, vaginal, topical, oral and inhaled delivery.

24. A method for selectively inhibiting the growth of a cell comprising contacting a cell with an amount of an isolated dsRNA of claim 1 sufficient to inhibit the growth of the cell.

25. The method of claim 24, wherein said cell is a tumor cell of a subject.

26. The method of claim 24, wherein said cell is a prostate cancer cell.

27. A formulation comprising the isolated dsRNA of claim 1, wherein said dsRNA is present in an amount effective to reduce target AR RNA levels when said dsRNA is introduced into a mammalian cell in vitro by an amount (expressed by %) selected from the group consisting of at least 10%, at least 50% and at least 80-90%, and wherein said dsRNA possesses greater potency than isolated 21mer siRNAs directed to the identical at least 19 nucleotides of said target AR cDNA in reducing target AR RNA levels when assayed in vitro in a mammalian cell at an effective concentration in the environment of a cell of 1 nanomolar or less.

28. The formulation of claim 27, wherein said effective amount is selected from the group consisting of 1 nanomolar or less, 200 picomolar or less, 100 picomolar or less, 50 picomolar or less, 20 picomolar or less, 10 picomolar or less, 5 picomolar or less, 2, picomolar or less and 1 picomolar or less in the environment of said cell.

29. A mammalian cell containing the isolated dsRNA of claim 1.

30. A pharmaceutical composition comprising the isolated dsRNA of claim 1 and a pharmaceutically acceptable carrier.

31. A kit comprising the isolated dsRNA of claim 1 and instructions for its use.

32. A method for treating or preventing an AR-associated disease or disorder in a subject comprising administering the isolated dsRNA of claim 1 and a pharmaceutically acceptable carrier to the subject in an amount sufficient to treat or prevent said AR-associated disease or disorder in said subject, thereby treating or preventing said AR-associated disease or disorder in said subject.

33. The method of claim 32, wherein said AR-associated disease or disorder is selected from the group consisting of prostate cancer and adenocarcinoma.

34. An isolated dsRNA molecule, consisting of: (a) a sense region and an antisense region, wherein said sense region and said antisense region together form a duplex region consisting of 15-35 base pairs and said antisense region comprises a sequence that is the complement of a sequence selected from the group consisting of SEQ ID NOs: 2399, 3209, 1589, 2804, 5238-5241, 4172 and 4895; and (b) from zero to two 3' overhang regions, wherein each overhang region is six or fewer nucleotides in length.

35. The isolated dsRNA molecule of claim 34, wherein said duplex region consists of 19-35 base pairs.

36. The isolated dsRNA molecule of claim 34, wherein said duplex region consists of 25-35 base pairs.

37. The isolated dsRNA molecule of claim 34, wherein said duplex region consists of 25-30 base pairs.

38. An isolated double stranded ribonucleic acid (dsRNA) comprising first and second nucleic acid strands and a duplex region of at least 25 base pairs, wherein said first strand is 25-34 nucleotides in length and said second strand of said dsRNA is 26-35 nucleotides in length and comprises 1-5 single-stranded nucleotides at its 3' terminus, wherein said second oligonucleotide strand is sufficiently complementary to SEQ ID NO: 2399 along at least 19 nucleotides of said second oligonucleotide strand length to reduce AR target gene expression when said double stranded nucleic acid is introduced into a mammalian cell.

39. The isolated dsRNA of claim 38, wherein said second oligonucleotide strand is complementary to a target AR cDNA sequence selected from the group consisting of SEQ ID NOs: 3766, 3768 and 3770 along at most 27 nucleotides of said second oligonucleotide strand length.

40. The isolated dsRNA of claim 38, wherein starting from the first nucleotide (position 1) at the 3' terminus of the first oligonucleotide strand, position 1, 2 and/or 3 is substituted with a modified nucleotide.

41. The isolated dsRNA of claim 38, wherein said 3' terminus of said first strand and said 5' terminus of said second strand form a blunt end.

42. The isolated dsRNA of claim 38, wherein said first strand is 25 nucleotides in length and said second strand is 27 nucleotides in length.

\* \* \* \* \*